US010739354B2

(12) United States Patent
Jensen et al.

(10) Patent No.: US 10,739,354 B2
(45) Date of Patent: Aug. 11, 2020

(54) METHODS FOR SCREENING VOLTAGE-GATED PROTEINS

(71) Applicant: D.E. Shaw Research, LLC, New York, NY (US)

(72) Inventors: Morten Østergaard Jensen, New York, NY (US); David Wayne Borhani, Hartsdale, NY (US); Vishwanath Jogini, Hyderabad (IN)

(73) Assignee: D.E. SHAW RESEARCH, LLC, New York, NY (US)

( * ) Notice: Subject to any disclaimer, the term of this patent is extended or adjusted under 35 U.S.C. 154(b) by 294 days.

(21) Appl. No.: 15/295,436

(22) Filed: Oct. 17, 2016

(65) Prior Publication Data

US 2017/0115309 A1    Apr. 27, 2017

Related U.S. Application Data

(60) Division of application No. 14/473,386, filed on Aug. 29, 2014, which is a continuation-in-part of application No. PCT/US2013/028324, filed on Feb. 28, 2013.

(60) Provisional application No. 61/604,897, filed on Feb. 29, 2012.

(51) Int. Cl.
*G01N 33/53* (2006.01)
*G01N 33/68* (2006.01)
*C12Q 1/42* (2006.01)
*G01N 33/487* (2006.01)

(52) U.S. Cl.
CPC .......... *G01N 33/6872* (2013.01); *C12Q 1/42* (2013.01); *G01N 33/48721* (2013.01); *G01N 33/48728* (2013.01); *G01N 33/6842* (2013.01); *G01N 2333/916* (2013.01); *G01N 2500/00* (2013.01); *G01N 2500/04* (2013.01)

(58) Field of Classification Search
None
See application file for complete search history.

(56) References Cited

U.S. PATENT DOCUMENTS

| | | |
|---|---|---|
| 5,661,035 A | 8/1997 | Tsien et al. |
| 5,804,387 A | 9/1998 | Cormack et al. |
| 6,077,680 A | 6/2000 | Kern et al. |
| 6,083,986 A | 7/2000 | Castle et al. |
| 6,107,066 A | 8/2000 | Tsien et al. |
| 6,194,458 B1 | 2/2001 | Baker et al. |
| 6,342,379 B1 | 1/2002 | Tsien et al. |
| 6,627,449 B1 | 9/2003 | Tsien et al. |
| 6,686,193 B2 | 2/2004 | Maher et al. |
| 6,780,975 B2 | 8/2004 | Tsien et al. |
| 6,800,733 B2 | 10/2004 | Tsien et al. |
| 2007/0111262 A1* | 5/2007 | Li .................. G01N 33/5008 435/7.2 |
| 2007/0209935 A1 | 9/2007 | Vogel et al. |
| 2008/0311578 A1 | 12/2008 | Chong et al. |
| 2009/0005386 A1 | 1/2009 | Abbott et al. |
| 2009/0081724 A1 | 3/2009 | Mulley et al. |
| 2011/0011632 A1 | 1/2011 | Nakao et al. |
| 2019/0187094 A1* | 6/2019 | Reid ............... G01N 33/48721 |

FOREIGN PATENT DOCUMENTS

| | | |
|---|---|---|
| EP | 0045665 A1 | 2/1982 |
| WO | WO-0025774 A1 | 5/2000 |
| WO | WO-0140231 A1 | 6/2001 |
| WO | WO-2008038051 A2 | 4/2008 |
| WO | WO-11011632 A1 | 1/2011 |

OTHER PUBLICATIONS

Ackerman, M. J., et al., "Ion Channels—Basic Science and Clinical Disease," The New England Journal of Medicine, vol. 336, No. 22, pp. 1575-1586 (May 29, 1997).
Aggarwal, S. K. and MacKinnon, R., "Contribution of the S4 Segment to Gating Charge in the Shaker K+ Channel," Neuron, vol. 16, No. 6, pp. 1169-1177 (Jun. 1996).
Aksimentiev, A. and Schulten, K., "Imaging α-Hemolysin with Molecular Dynamics: Ionic Conductance, Osmotic Permeability, and the Electrostatic Potential Map," Biophysical Journal, vol. 88, pp. 3745-3761 (Jun. 2005).
Alabi, A. A., et al., "Portability of paddle motif function and pharmacology in voltage sensors," Nature, vol. 450, No. 7168, pp. 370-375, Author Manuscript—21 pages (Nov. 15, 2007).
Almquist, R. G., et al., "Synthesis and biological activity of a ketomethylene analogue of a tripeptide inhibitor of angiotensin converting enzyme," Journal of Medicinal Chemistry, vol. 23, No. 12, pp. 1392-1398 (1980).
Ando, H., et al., "Coupled K+—Water Flux through the HERG Potassium Channel Measured by an Osmotic Pulse Method," J. Gen. Physiol., vol. 126, No. 5, pp. 529-537 (Nov. 2005).
Baburin, I., et al., "Automated fast perfusion of Xenopus oocytes for drug screening," Pjlugers Arch., vol. 453, No. 1, pp. 117-123, Author Manuscript—12 pages (Oct. 2006).
Baell, J. B., et al., "Khellinone Derivatives as Blockers of the Voltage-Gated Potassium Channel Kv1.3: Synthesis and Immunosuppressive Activity," Journal of Medicinal Chemistry, vol. 47, No. 9, pp. 2326-2336, 13 pages (Apr. 22, 2004).
Banerjee, A. and MacKinnon, R., "Inferred motions of the S3a helix during voltage-dependent K+ channel gating," J. Mol. Biol., vol. 381, No. 3, Author Manuscript—17 pages (Sep. 5, 2008).
Beeton, C., et al., "Targeting Effector Memory T Cells with a Selective Peptide Inhibitor of Kv1.3 Channels for Therapy of Autoimmune Diseases," Molecular Pharmacology, vol. 67, No. 4, pp. 1369-1381 (2005).

(Continued)

*Primary Examiner* — Michael D Pak
(74) *Attorney, Agent, or Firm* — Wilmer Cutler Pickering Hale and Dorr LLP

(57) ABSTRACT

In one aspect, the invention relates to a method for identifying a compound which modulates the activity of a voltage-gated protein. In certain embodiments, the voltage gate protein is a voltage-gated ion channel. In certain embodiments, the voltage-gated protein is a voltage sensitive phosphatase. In certain embodiments, the voltage-gated protein used in conjunction with the methods of the invention is modified to altered permeability or voltage sensitivity.

18 Claims, 199 Drawing Sheets
(30 of 199 Drawing Sheet(s) Filed in Color)
Specification includes a Sequence Listing.

(56) References Cited

OTHER PUBLICATIONS

Bennett, C. H., "Efficient estimation of free energy differences from Monte Carlo data," J. Comput. Phys., vol. 22, pp. 245-268 (May 1976).
Berendsen, H. J. C., et al., "Molecular dynamics with coupling to an external bath," J. Chem. Phys., vol. 81, pp. 3684-3690 (Oct. 1984).
Berger, T. K. and Isacoff, E. Y., "The pore of the voltage-gated proton channel," Neuron, vol. 72, No. 6, pp. 991-1000 (Dec. 22, 2011).
Bezanilla, Francisco, "The Voltage Sensor in Voltage-Dependent Ion Channels," Physiological Reviews, vol. 80, No. 2, pp. 555-592 (Apr. 2000).
Bosmans, F., et al., "Deconstructing voltage sensor function and pharmacology in sodium channels," Nature, vol. 456, No. 7219, pp. 202-208, Author Manuscript—19 pages (Nov. 13, 2008).
Bourinet, E., et al., "Splicing of $\alpha_{1A}$ subunit gene generates phenotypic variants of P- and Q-type calcium channels," Nat. Neurosci., vol. 2, No. 5, pp. 407-415, 11 pages (May 1999).
Bowers, K. J., et al., "Scalable algorithms for molecular dynamics simulations on commodity clusters," Proc. ACM/IEEE Conf. on Supercomputing (SC06), ACM Press, New York, 13 pages (2006).
Campos, F. V., et al., "Two atomic constraints unambiguously position the S4 segment relative to S1 and S2 segments in the closed state of Shaker K channel," PNAS, vol. 104, No. 19, pp. 7904-7909 (May 8, 2007).
Cannon, Stephen C., "Voltage-sensor mutations in channelopathies of skeletal muscle," J. Physiol., vol. 588, No. 11, pp. 1887-1895 (2010).
Catterall, W. A. and Yarov-Yarovoy, V., "Helical motion of an S4 voltage sensor revealed by gating pore currents," Channels, vol. 4, No. 2, pp. 75-77 (Mar./Apr. 2010).
Catterall, W. A., et al., "International Union of Pharmacology. XLVII. Nomenclature and Structure-Function Relationships of Voltage-Gated Sodium Channels," Pharmacological Reviews, vol. 57, No. 4, pp. 397-409 (2005).
Catterall, W. A., et al., "International Union of Pharmacology. XLVIII. Nomenclature and structure-function relationships of voltage-gated calcium channels," Pharmacological Review, vol. 57, pp. 411-425 (2005).
Catterall, William A., "Ion Channel Voltage Sensors: Structure, Function, and Pathophysiology," Neuron, vol. 67, No. 6, pp. 915-928, Author Manuscript—26 pages (Sep. 23, 2010).
Catterall, William A., "Structure and regulation of voltage-gated $Ca^{2+}$ channels," Annu. Rev. Cell Dev. Biol., vol. 16, pp. 521-555, 37 pages (2000).
Clapham, D. E. and Garbers, D. L., "International Union of Pharmacology. L. Nomenclature and Structure-Function Relationships of CatSper and Two-Pore Channels," Pharmacological Reviews, vol. 57, No. 4, pp. 451-454 (2005).
Daniel, S., et al., "Screening for potassium channel modulators by a high through-put 86-rubidium efflux assay in a 96-well microtiter plate," Journal of Pharmacological Methods, vol. 25, No. 3, pp. 185-193 (May 1991).
Dayhoff, M. O., et al., "Chapter 22: A Model of Evolutionary Change in Proteins," Atlas of Protein Sequence and Structure, vol. 5, Suppl. 3, pp. 345-352 (1978).
Delemotte, L., et al., "Effect of sensor domain mutations on the properties of voltage-gated ion channels: Molecular dynamics studies of the potassium channel Kv1.2," Biophys. J., vol. 99, pp. L72-L74, Total pp. 249 including Supplementary Supporting Information (Nov. 2010).
Dilly, S., et al., "Ion-Channel Modulators: More Diversity Than Previously Thought," Chembiochem., vol. 12, No. 12, pp. 1808-1812 (Aug. 16, 2011).
Dunlap, K., et al., "Exocytotic $Ca^{2+}$ channels in mammalian central neurons," Trends Neurosci., vol. 18, No. 2, pp. 89-98 (Feb. 1995).
Ellinor, P. T., et al., "Structural determinants of the blockade of N-type calcium channels by a peptide neurotoxin," Nature, vol. 372, No. 6503, pp. 272-275, 6 pages (Nov. 17, 1994).

Evans, B. E., et al., "Design of nonpeptidal ligands for a peptide receptor: cholecystokinin antagonists," J. Med. Chem., vol. 30, No. 7, pp. 1229-1239 (Jul. 1987).
Fauchere, Jean-Luc, "Elements for the rational design of peptide drugs," Advances in Drug Research, vol. 15, pp. 29-69, 43 pages (1986).
Felix, J. P., et al., "Identification and Biochemical Characterization of a Novel Nortriterpene Inhibitor of the Human Lymphocyte Voltage-Gated Potassium Channel, Kv1.3," Biochemistry, vol. 38, No. 16, pp. 4922-4930 (Apr. 20, 1999).
Feng, Z.-P., et al., "Residue $Gly^{1326}$ of the N-type Calcium Channel $\alpha_{1B}$ Subunit Controls Reversibility of $\omega$-Conotoxin GVIA and MVIIA Block," The Journal of Biological Chemistry, vol. 276, No. 19, pp. 15728-15735 (May 11, 2001).
Garcia, L. W., et al., "The value of multiple fluid specimens in the cytological diagnosis of malignancy," Mod. Pathol., vol. 7, No. 6, pp. 665-668, 6 pages (Aug. 1994).
Garcia, M. L., et al., "Purification and characterization of three inhibitors of voltage-dependent $K^+$ channels from *Leiurus quinquestriatus* var. *hebraeus* venom," Biochemistry, vol. 33, No. 22, pp. 6834-6839, 6 pages (Jun. 7, 1994).
Goldin, et al., "Nomenclature of Voltage-Gated Sodium Channels," Neuron vol. 28 pp. 365-368 (2000).
Gonzalez, J. E. and Tsien, R. Y., "Improved indicators of cell membrane potential that use fluorescence resonance energy transfer," Chemistry & Biology, vol. 4, No. 4, pp. 269-277 (Mar. 6, 1997).
González, J. E. and Maher, M. P., "Cellular Fluorescent Indicators and Voltage/Ion Probe Reader (VIPR TM): Tools for Ion Channel and Receptor Drug Discovery," Receptors and Channels, vol. 8, No. 5-6, pp. 283-295 (2002).
González, J. E., et al., "Cell-based assays and instrumentation for screening ion-channel targets," Drug Discov. Today, vol. 4, No. 9, pp. 431-439 (Sep. 1999).
Grinvald, A., et al., "Optical imaging of neuronal activity," Physiol. Rev., vol. 68, No. 4, pp. 1285-1366, 84 pages (Oct. 1988).
Gross, A. and MacKinnon, R., "Agitoxin Footprinting the Shaker Potassium Channel Pore," Neuron, vol. 16, pp. 399-406 (Feb. 1996).
Gross, A., et al., "Transfer of the scorpion toxin receptor to an insensitive potassium channel," Neuron, vol. 13, No. 4, pp. 961-966 (Oct. 1994).
Gutman, G. A., et al., "International Union of Pharmacology. LIII. Nomenclature and Molecular Relationships of Voltage-Gated Potassium Channels," Pharmacological Reviews, vol. 57, No. 4, pp. 473-508 (2005).
Hamill, O. P., et al., "Improved Patch-Clamp Techniques for High-Resolution Current Recording from Cells and Cell-Free Membrane Patches," Pflügers Arch., vol. 391, pp. 85-100 (May 1981).
Hann, M. M., et al., "On the double bond isostere of the peptide bond: preparation of an enkephalin analogue," Journal of the Chemical Society, Perkin Transactions 1, pp. 307-314 (1982).
Hanson, D. C., et al., "UK-78,282, a novel piperidine compound that potently blocks the Kv1.3 voltage-gated potassium channel and inhibits human T cell activation," British Journal of Pharmacology, vol. 126, No. 8, pp. 1707-1716 (1999).
Herrington, J. et al., "Identification of novel and selective Kv2 channel inhibitors," Mol. Pharmacol., vol. 80, No. 6, pp. 959-964, 24 total pages (Sep. 26, 2011).
Herrington, J., et al., "Blockers of the delayed-rectifier potassium current in pancreatic beta-cells enhance glucose-dependent insulin secretion," Diabetes, vol. 55, No. 4, pp. 1034-1042 (Apr. 2006).
Hille, Bertil, "Ion Channels of Excitable Membranes," Third Edition, Sinauer Associates, Inc., Sunderland, Massachusetts, Cover Page, Copyright Page and Table of Contents Only—13 pages (2001).
Hodgkin, A. L. and Huxley, A. F., "A Quantitative Description of Membrane Current and Its Application to Conduction and Excitation in Nerve," J. Physiol., vol. 117, pp. 500-544 (1952).
Hoffman, E. K. and Lambert, I. H., "On the similarity between the small Cl-channel and the taurine channel activated after cell swelling in Ehrlich ascites tumor cells," Jpn. J. Physiol., vol. 44, Supplement 2, pp. S49-S53, 7 pages (1994).

(56) References Cited

OTHER PUBLICATIONS

Hofmann, F., et al., "International Union of Pharmacology. LI. Nomenclature and Structure-Function Relationships of Cyclic Nucleotide-Regulated Channels," Pharmacological Reviews, vol. 57, No. 4, pp. 455-462 (Dec. 2005).
Holevinsky, K. O., et al., "ATP-sensitive K+ channel opener acts as a potent Cl-channel inhibitor in vascular smooth muscle cells," The Journal of Membrane Biology, vol. 137, No. 1, pp. 59-70 (Jan. 1994).
Holladay, M. W. and Rich, D. H., "Synthesis of hydroxyethylene and ketomethylene dipeptide isosteres," Tetrahedron Letters, vol. 24, No. 41, pp. 4401-4404 (1983).
Holtzclaw, J. D., et al., "Role of BK channels in hypertension and potassium secretion," Curr. Opin. Nephrol. Hypertens., vol. 20, No. 5, Author Manuscript—13 pages (Sep. 2011).
Hong, K. H. and Miller, C., "The Lipid-Protein Interface of a Shaker $K^+$ Channel," J. Gen. Physiol., vol. 115, pp. 51-58 (Jan. 2000).
Hruby, V. J. and Cai, M., "Design of Peptide and Peptidomimetic Ligands with Novel Pharmacological Activity Profiles," Annu. Rev. Pharmacol. Toxicol., vol. 53, pp. 557-580, Author Manuscript—34 pages (Oct. 2013).
Hruby, Victor J., "Conformational restrictions of biologically active peptides via amino acid side chain groups," Life Sci., vol. 31, No. 3, pp. 189-199 (Jul. 19, 1982).
Hudson, D., et al., "Methionine Enkephalin and Isosteric Analogues I. Synthesis on a Phenolic Resin Support," Int. J. Peptide Protein Res., vol. 14, No. 3 pp. 177-185 (Sep. 1979).
Humphrey, W., et al., "VMD: Visual Molecular Dynamics," J. Mol. Graphics, vol. 14, pp. 33-38 (Feb. 1996).
International Search Report and Written Opinion for International Application No. PCT/US13/28324 dated Jun. 14, 2013 (11 pages).
Islas, L. D. and Sigworth, F. J., "Voltage Sensitivity and Gating Charge in Shaker and Shab Family Potassium Channels," J. Gen. Physiol., vol. 114, pp. 723-741 (Nov. 1999).
Jennings-White, C. and Almquist, R. G., "Synthesis of ketomethylene analogs of dipeptides," Tetrahedron Letters, vol. 23, No. 25, pp. 2533-2534 (1982).
Jensen, M. Ø., et al., "Principles of conduction and hydrophobic gating in K+ channels," PNAS, vol. 107, No. 13, pp. 5833-5838 (Mar. 30, 2010).
Jensen, M. Ø., et al., "Reply to Domene and Furini: Distinguishing knock-on and vacancy diffusion mechanisms," Proc. Natl. Acad. Sci. USA, vol. 107, No. 33, E129, 1 page (Aug. 17, 2010).
Johnson, Iain, "Fluorescent probes for living cells," Histochem. J., vol. 30, No. 3, pp. 123-140 (Mar. 1998).
Jurkat-Rott, K., et al., "Pathophysiological role of omega pore current in channelopathies," Frontiers in Pharmacology, vol. 3, Article 112, pp. 1-19 (Jun. 2012).
Kalman, K., et al., "ShK-Dap$^{22}$, a Potent Kv1.3-specific Immunosuppressive Polypeptide," The Journal of Biological Chemistry, vol. 273, No. 49, pp. 32697-32707 (Dec. 4, 1998).
Katerinopoulos, Haralambos E., "The Coumarin Moiety as Chromophore of Fluorescent Ion Indicators in Biological Systems," Current Pharmaceutical Design, vol. 10, No. 30, pp. 3835-3852 (2004).
Khalili-Araghi, F., et al., "Molecular dynamics investigation of the omega-current in the Kv1.2 voltage sensor domains," Biophys. J., vol. 102, pp. 258-267 (Jan. 2012).
Khodorov, B. I. and Peganov, E., "Effect of calcium, magnesium, barium, nickel and Lanthanum ions on the hyperpolarization responses of single nodes of Ranvier," Biofizika, vol. 14, No. 3, pp. 500-512 (1969).
Klauda, J. B., et al., "Update of the CHARMM all-atom additive force fields for lipids: Validation on six lipid types," J. Phys. Chem. B, vol. 114, pp. 7830-7843 (2010).
Kobertz, W. R. and Miller, C., "K+ channels lacking the 'tetramerization' domain: implications for pore structure," Nat. Struct. Biol., vol. 6, No. 12, pp. 1122-1125 (Dec. 1999).
Krautler, V., et al., "A fast SHAKE algorithm to solve distance constraint equations for small molecules in molecular dynamics simulations," J. Comput. Chem., vol. 22, pp. 501-508 (2001).
Kurata, H. T., et al., "Altered state dependence of C-Type inactivation in the long and short forms of human Kv1.5," J. Gen. Physiol., vol. 118, pp. 315-332 (Sep. 2001).
Labro, A. J., et al., "KV channel gating requires a compatible S4-S5 linker and bottom part of S6, constrained by non-interacting residues," J. Gen. Physiol., vol. 132, No. 6, pp. 667-680 (2008).
Lacroix, J., et al., "Controlling the Activity of a Phosphatase and Tensin Homolog (PTEN) by Membrane Potential," Journal of Biological Chemistry, vol. 286, No. 20, pp. 17945-17953 (2011).
Lacroix, J. J. and Bezanilla, F., "Control of a final gating charge transition by a hydrophobic residue in the S2 segment of a $K^+$ channel voltage sensor," PNAS, vol. 108, No. 16, pp. 6444-6449 (Apr. 19, 2011).
Lainé, M., et al., "Atomic Proximity between S4 Segment and Pore Domain in Shaker Potassium Channels," Neuron, vol. 39, pp. 467-481 (Jul. 31, 2003).
Lam, Kit S., "Application of combinatorial library methods in cancer research and drug discovery," Anticancer Drug Des., vol. 12, No. 3, pp. 145-167, 25 pages (Apr. 1997).
Lampe, R. A., et al., "Isolation and pharmacological characterization of omega-grammotoxin SIA, a novel peptide inhibitor of neuronal voltage-sensitive calcium channel responses," Mol. Pharmacol., vol. 44, No. 4, pp. 451-460 (Aug. 1993).
Larsson, H. P., et al., "Transmembrane Movement of the Shaker K+ Channel S4," Neuron, vol. 16, No. 2, pp. 387-397 (Feb. 1996).
Ledwell, J. L. and Aldrich, R. W., "Mutations in the S4 region isolate the final voltage-dependent cooperative step in potassium channel activation," J. Gen. Physiol., vol. 113, pp. 389-414 (Mar. 1999).
Lee, S., et al., "Solution structure of GxTX-1E, a high affinity tarantula toxin interacting with voltage sensors in Kv2.1 potassium channels," Biochemistry, vol. 49, No. 25, pp. 5134-5142, Author Manuscript—19 pages. (Jun. 29, 2010).
Loboda, A., et al., "Resolving the Gating Charge Movement Associated with Late Transitions in K Channel Activation," Biophysical Journal, vol. 81, No. 2, pp. 905-916 (Aug. 2001).
Long, S. B., et al., "Atomic structure of a voltage-dependent K+ channel in a lipid membrane-like environment," Nature, vol. 450, pp. 376-382 (Nov. 15, 2007).
Lowe, C. R. and Goldfinch, M. J., "[31] Solid-Phase Optoelectronic Biosensors," Methods Enzymol., vol. 137, Part D, pp. 338-348, 13 pages (1988).
MacKerell, Jr., A. D., et al., "All-atom empirical potential for molecular modeling and dynamics studies of proteins," J. Phys. Chem. B, vol. 102, pp. 3586-3616 (1998).
MacKerell, Jr., A. D., et al., "Extending the treatment of backbone energetics in protein force fields: Limitations of gas-phase quantum mechanics in reproducing protein conformational distributions in molecular dynamics simulations," J. Comput. Chem., vol. 25, pp. 1400-1415 (2004).
MacKinnon, R. and Miller, C., "Mutant potassium channels with altered binding of charybdotoxin, a pore-blocking peptide inhibitor," Science, vol. 245, No. 4924, pp. 1382-1385, 6 pages (Sep. 22, 1989).
MacKinnon, R., et al., "Mapping the receptor site for charybdotoxin, a pore-blocking potassium channel inhibitor," Neuron, vol. 5, No. 6, pp. 767-771 (Dec. 1990).
McCormack, K., et al., "A role for hydrophobic residues in the voltage-dependent gating of Shaker K + channels," Proc. Natl. Acad. Sci. USA, vol. 88, pp. 2931-2935 (Apr. 1991).
Milescu, M., et al., "Interactions between lipids and voltage sensor paddles detected with tarantula toxins," Nat. Struct. Mol. Biol., vol. 16, No. 10, pp. 1080-1085, Author Manuscript—17 pages (Oct. 2009).
Mintz, I. M., et al., "P-type calcium channels blocked by the spider toxin omega-Aga-IVA," Nature, vol. 355, No. 6363, pp. 827-829, 5 pages (Feb. 7, 1992).
Morley, J. S., "Modulation of the action of regulatory peptides by structural modification," TIPS, vol. 1, No. 2, pp. 463-468 (Dec. 1980).

(56) References Cited

OTHER PUBLICATIONS

Murata, Y., et al., "Phosphoinositide phosphatase activity coupled to an intrinsic voltage sensor," Nature, vol. 435, pp. 1239-1243 (Jun. 30, 2005).
Musset, B., et al., "Aspartate112 is the Selectivity Filter of the Human Voltage Gated Proton Channel," Nature, vol. 480, No. 7376, pp. 273-277, Author Manuscript—11 pages (Jun. 8, 2012).
Neher, E. and Sakmann, B., "Single-channel currents recorded from membrane of denervated frog muscle fibres," Letters to Nature, vol. 260, pp. 799-802 (Apr. 29, 1976).
Nelson, R. D., et al., "Modular Assembly of Voltage-Gated Channel Proteins: A Sequence Analysis and Phylogenetic Study," J. Mol. Microbiol. Biotechnol., vol. 1, No. 2, pp. 281-287 (1999).
Nguyen, A., et al., "Novel nonpeptide agents potently block the C-type inactivated conformation of Kv1.3 and suppress T cell activation," Molecular Pharmacology, vol. 50, No. 6, pp. 1672-1679, 10 pages (Dec. 1996).
Noda, M., et al., "Primary structure of *Electrophorus electricus* sodium channel deduced from cDNA sequence," Nature, vol. 312, No. 5990, pp. 1-7 (Nov. 8, 1984).
Okamura, Y. and Dixon, J. E., "Voltage-Sensing Phosphatase: Its Molecular Relationship With PTEN," Physiology, vol. 26, pp. 6-13 (2011).
Okamura, Y., et al., "Voltage-sensing phosphatase: actions and potentials," J. Physiol., vol. 587, No. 3, pp. 513-520 (2009).
Olivera, B. M., et al., "Calcium channel diversity and neurotransmitter release: the omega-conotoxins and omega-agatoxins," Annu. Rev. Biochem., vol. 63, pp. 823-867, 47 pages (1994).
Pathak, M. M., et al., "Closing in on the Resting State of the Shaker K+ Channel," Neuron, vol. 56, No. 1, pp. 124-140 (Oct. 4, 2007).
Payandeh, J., et al., "The crystal structure of a voltage-gated sodium channel," Nature, vol. 475, pp. 353-358 (Jul. 21, 2011).
Pearson, W. R. and Lipman, D. J., "Improved tools for biological sequence comparison," PNAS, vol. 85, pp. 2444-2448 (Apr. 1988).
Pennington, M. W., et al., "Engineering a Stable and Selective Peptide Blocker of the Kv1.3 Channel in T Lymphocytes," Molecular Pharmacology, vol. 75, No. 4, pp. 762-773 (2009).
Pennington, M. W., et al., "Identification of Three Separate Binding Sites on SHK Toxin, a Potent Inhibitor of Voltage-Dependent Potassium Channels in Human T-Lymphocytes and Rat Brain," Biochemical and Biophysical Research Communications, vol. 219, No. 3, pp. 696-701 (Feb. 27, 1996).
Perez-Reyes, Edward, "Molecular Physiology of Low-Voltage-Activated T-type Calcium Channels," Physiol. Rev., vol. 83, No. 1, pp. 117-161 (Jan. 2003).
Prütting, S. and Grissmer, S., "A Novel Current Pathway Parallel to the Central Pore in a Mutant Voltage-gated Potassium Channel," The Journal of Biological Chemistry, vol. 286, pp. 20031-20042 (Jun. 3, 2011).
Rai, M. and Padh, H., "Expression systems for production of heterologous proteins," Current Science, vol. 80, No. 9, pp. 1121-1128 (May 10, 2001).
Ramsey, I. S., et al., "A voltage-gated proton-selective channel lacking the pore domain," Nature, vol. 440, pp. 1213-1216 with Supplemental Data—11 pages (Apr. 27, 2006).
Rauer, H., et al., "Structural Conservation of the Pores of Calcium-activated and Voltage-gated Potassium Channels Determined by a Sea Anemone Toxin," The Journal of Biological Chemistry, vol. 274, pp. 21885-21892 (Jul. 30, 1999).
Rodríguez, B. M. and Bezanilla, F., "Transitions near the open state in Shaker K(+)-channel: probing with temperature," Neuropharmacology, vol. 35, No. 7, pp. 775-785 (1996).
Rodríguez, B. M., et al., "Voltage Gating of Shaker K+ Channels. *The Effect of Temperature on Ionic and Gating Currents*," J. Gen. Physiol., vol. 112, pp. 223-242 (Aug. 1998).
Roux, B., "The membrane potential and its representation by a constant electric field in computer simulations," Biophys. J., vol. 95, pp. 4205-4216 (Nov. 2008).

Ruta, V., et al., "Calibrated Measurement of Gating-Charge Arginine Displacement in the KvAP Voltage-Dependent K+ Channel," Cell, vol. 123, No. 3, pp. 463-475 (Nov. 4, 2005).
Schmidt, D., et al., "Phospholipids and the origin of cationic gating charges in voltage sensors," Nature, vol. 444, No. 7120, pp. 775-779 with Supplemental Data—10 pages (Dec. 7, 2006).
Schmitz, A., et al., "Design of PAP-1, a Selective Small Molecule Kv1.3 Blocker, for the Suppression of Effector Memory T Cells in Autoimmune Diseases," Molecular Pharmacology, vol. 68, No. 5, pp. 1254-1270 (Nov. 2005).
Schoppa, N. E. and Sigworth, F. J., "Activation of Shaker Potassium Channels. III. *An Activation Gating Model for Wild-Type and V2 Mutant Channels*," J. Gen. Physiol., vol. 111, pp. 313-342 (Feb. 1998).
Schoppa, N., et al., "The Size of Gating Charge in Wild-Type and Mutant Shaker Potassium Channels," Science, vol. 255, pp. 1712-1715 (1992).
Shan, Y., et al., "Gaussian split Ewald: A fast Ewald mesh method for molecular simulation," J. Chem. Phys., vol. 122, 054101, pp. 1-13 (2005).
Shaw, D. E., et al., "Millisecond-Scale Molecular Dynamics Simulations on Anton," Proc. Conf. High Performance Computing, Networking, Storage and Analysis (SC09), ACM Press, New York, 11 pages (Nov. 14-20, 2009).
Sigworth, Fred J., "Life's transistors," Nature, vol. 423, pp. 21-22 (May 1, 2003).
Snutch, T. P. and Reiner, P. B., "$Ca^{2+}$ channels: diversity of form and function," Current Opinion in Neurobiology, vol. 2, Issue 3, pp. 247-253 (Jun. 1992).
Sokolov, S., et al., "Gating pore current in an inherited ion channelopathy," Nature, vol. 446, pp. 76-78 (Mar. 1, 2007).
Sokolov, S., et al., "Ion permeation and block of the gating pore in the voltage sensor of $Na_v1.4$ channels with hypokalemic periodic paralysis mutations," The Journal of General Physiology, vol. 136, No. 2, pp. 225-236 (2010).
Sokolov, S., et al., "Ion Permeation through a Voltage-Sensitive Gating Pore in Brain Sodium Channels Having Voltage Sensor Mutations," Neuron, vol. 47, pp. 183-189 (Jul. 21, 2005).
Spatola, A. F., et al., "Structure-activity relationships of enkephalins containing serially replaced thiomethylene amide bond surrogates," Life Sciences, vol. 38, No. 14, pp. 1243-1249 (Apr. 7, 1986).
Springs, B. and Haake, P., "Equilibrium constants for association of guanidinium and ammonium ions with oxyanions: The effect of changing basicity of the oxyanion," Bioorg. Chem., vol. 6, pp. 181-190 (1977).
Starace, D. M., et al., "A proton pore in a potassium channel voltage sensor reveals a focused electric field," Nature, vol. 427, pp. 548-553 (Feb. 5, 2004).
Starace, D. M., et al., "Voltage-Dependent Proton Transport by the Voltage Sensor of the Shaker $K^+$ Channel," Neuron, vol. 19, pp. 1319-1327 (Dec. 1997).
Stork, D., et al., "State dependent dissociation of HERG channel inhibitors," Br. J. Pharmacol., vol. 151, No. 8, pp. 1368-1376 (Jun. 2007).
Striessnig, Jörg, "Pharmacology, structure and function of cardiac L-type Ca(2+) channels," Cell Physiol. Biochem., vol. 9, No. 4-5, pp. 242-269 (1999).
Swartz, K. J. and MacKinnon, R., "An Inhibitor of the Kv2.1 Potassium Channel Isolated from the Venom of a Chilean Tarantula," Neuron, vol. 15, pp. 941-949 (Oct. 1995).
Swartz, K. J. and MacKinnon, R., "Hanatoxin Modifies the Gating of a Voltage-Dependent K+ Channel through Multiple Binding Sites," Neuron, vol. 18, pp. 665-673 (Apr. 1997).
Swartz, K. J. and MacKinnon, R., "Mapping the Receptor Site for Hanatoxin, a Gating Modifier of Voltage-Dependent K+ Channels," Neuron, vol. 18, pp. 675-682 (Apr. 1997).
Swartz, Kenton J., "Sensing voltage across lipid membranes," Nature, vol. 456, pp. 891-897 (Dec. 18-25, 2008).
Tanford, Charles, "The association of acetate with ammonium and guanidinium ions," J. Am. Chem. Soc., vol. 76, pp. 945-946 (Sep. 3, 1953).

(56) References Cited

OTHER PUBLICATIONS

Tao, X. and MacKinnon, R., "Functional analysis of Kv1.2 and paddle chimera Kv channels in planar lipid bilayers," J. Mol. Biol., vol. 382, No. 1, pp. 24-33, Author Manuscript—16 pages (Sep. 26, 2008).
Tao, X., et al., "A Gating Charge Transfer Center in Voltage Sensors," Science, vol. 328, No. 5974, pp. 67-73, Author Manuscript—16 pages (Apr. 2, 2010).
Tempel, B. L., et al., "Sequence of a probable potassium channel component encoded at Shaker locus of *Drosophila*," Science, vol. 237, pp. 770-775, 7 pages (Aug. 14, 1987).
Terstappen, Georg C., "Nonradioactive Rubidium Ion Efflux Assay and Its Applications in Drug Discovery and Development," ASSAY and Drug Development Technologies, vol. 2, No. 5, pp. 553-559 (2004).
Terstappen, Georg C., "Functional analysis of native and recombinant ion channels using a high-capacity nonradioactive rubidium efflux assay," Anal. Biochem., vol. 272, No. 2, pp. 149-155 (Aug. 1, 1999).
Tombola, F., et al., "How Does Voltage Open an Ion Channel," Annu. Rev. Cell Dev. Biol., vol. 22, pp. 23-52 (2006).
Tombola, F., et al., "The twisted ion-permeation pathway of a resting voltage-sensing domain," Nature, vol. 445, No. 7127, pp. 546-549 (Feb. 1, 2007).
Tombola, F., et al., "Voltage-Sensing Arginines in a Potassium Channel Permeate and Occlude Cation-Selective Pores," Neuron, vol. 45, pp. 379-388 (Feb. 3, 2005).
Triggle, D. J., et al., "Voltage-Gated Ion Channels as Drug Targets," Wiley-VCH Verlag GmbH & Co. KGaA, Cover Page Copyright Page, Volume Page, Table of Contents, Preface and Chapter 3 (pp. 19-36) and Chapter 4 (pp. 37-63) 57 pages total (2006).
Tu, T., et al., "A Scalable Parallel Framework for Analyzing Terascale Molecular Dynamics Simulation Trajectories," Proceedings of the ACM/IEEE Conference on Supercomputing (SC08), ACM Press, New York, 12 pages (2008).
VanDongen, A. M. J., et al., "Alteration and restoration of K+ channel function by deletions at the N- and C-termini," Neuron, vol. 5, No. 4, pp. 433-443 (Oct. 1990).
Veber, D. F. and Freidinger, R. M., "The design of metabolically-stable peptide analogs," Trends in Neurosciences, vol. 8, pp. 392-396 (Sep. 1985).
Vennekamp, J., et al., "Kv1.3-Blocking 5-Phenylalkoxypsoralens: a New Class of Immunomodulators," Molecular Pharmacology, vol. 65, No. 6, pp. 1364-1374 (Jun. 2004).
Vestergaard-Bogind, B., et al., "Single-file diffusion through the $CA^{2+}$-activated $K^+$ channel of human red cells," The Journal of Membrane Biology, vol. 88, No. 1, pp. 67-75 (Feb. 1985).
Wang, H.-R., et al., "Selective inhibition of the Kir2 family of inward rectifier potassium channels by a small molecule probe: the discovery, SAR and pharmacological characterization of ML133," ACS Chem. Biol., vol. 6, No. 8, pp. 845-856, Author Manuscript—24 pages (Aug. 19, 2011).
Weaver, C. D., et al., "A Thallium-Sensitive, Fluorescence-Based Assay for Detecting and Characterizing Potassium Channel Modulators in Mammalian Cells," Journal of Biomolecular Screening, vol. 9, No. 8, pp. 671-677 (2004).
Wei, A. D., et al., "International Union of Pharmacology. LII. Nomenclature and Molecular Relationships of Calcium-Activated Potassium Channels," Pharmacological Reviews, vol. 57, No. 4, pp. 463-472 (2005).
Wimley, W. C. and White, S. H., "Experimentally determined hydrophobicity scale for proteins at membrane interfaces," Nature Structural Biology, vol. 3, No. 10, pp. 842-848 (Oct. 1996).
Winterfield, J. R. and Swartz, K. J., "A Hot Spot for the Interaction of Gating Modifier Toxins with Voltage-dependent Ion Channels," J. Gen. Physiol., vol. 116, No. 5, pp. 637-644 (Nov. 2000).
Wulff, H., et al., "Alkoxypsoralens, novel nonpeptide blockers of Shaker-type K+ channels: synthesis and photoreactivity," J. Med. Chem., vol. 41, No. 23, pp. 4542-4549, 10 pages (Nov. 5, 1998).
Xu, Y., et al., "Removal of phospho-head groups of membrane lipids immobilizes voltage sensors of K+ channels," Nature, vol. 451, pp. 826-829, Author Manuscript—12 pages (Feb. 14, 2008).
Yifrach, O., et al., "Energetics of Pore Opening in a Voltage-Gated K+ Channel," Cell, vol. 111, No. 2, pp. 231-239 (Oct. 18, 2002).
Zimmerberg, J., et al., "Solute inaccessible aqueous volume changes during opening of the potassium channel of the squid giant axon," Biophysical Journal, vol. 57, pp. 1049-1064 (May 1990).
Vladimir Yarov-Yarovoy, et al., "Structural Basis for Gating Charge Movement in the Voltage Sensor of a Sodium Channel with Supporting Information," PNAS, vol. 109, No. 2, Jan. 10, 2012, pp. E93-E102; 1-21; 1-2 (33 pages).
Stanislav Sokolov, et al., "Depolarization-Activated Gating Pore Current Conducted by Mutant Sodium Channels in Potassium-Sensitive Normokalemic Periodic Paralysis," PNAS, vol. 105, No. 50, Dec. 16, 2008, pp. 19980-19985 (6 pages).
Fenfen Wu, et al., Stac3 Enhances Expression of Human $Ca_v1.1$ in Xenopus Oocytes and Reveals Gating Pore Currents in HypoPP Mutant Channels, J. Gen. Physiol., vol. 150, No. 3, pp. 475-489 (15 pages).

\* cited by examiner

Figures 6A-D

| Ligand | Sensor | Ligand ff | Escapes? |
|---|---|---|---|
| Zinc0 | Sens A | Gaff | |
| Zinc0 | Sens B | Gaff | |
| Zinc0 | Sens C | Gaff | |
| Zinc0 | Sens D | Gaff | YES - 5µs |
| Zinc1 | Sens C | Gaff | |
| Zinc2 | Sens C | Gaff | |
| Zinc0 | Sens C | CGenff | YES – 500 ns |
| Zinc1 | Sens C | CGenff | |
| Zinc2 | Sens C | CGenff | YES - 6µs |
| DWB_12_3 | Sens C | CGenff | |
| DWB_12_6 | Sens C | CGenff | YES – 5 µs |

Figure 9

| Ligand | Sensor | Field | Escapes? |
|---|---|---|---|
| Zinc0 | Sens C (run2) | 0 mV | YES |
| Zinc0 | Sens C (run3) | 0 mV | |
| Zinc1 | Sens C | Depol 130mV | YES |
| Zinc1 | Sens C | Depol 65mV | |
| DWB_12_3 | Sens C | Depol 130mV | YES |
| DWB_12_3 | Sens C | Depol 65 mV | |
| Zinc0 | Sens C | Hyperpol 65 mV | |
| Zinc2 | Sens C | Hyperpol 65 mV | |

Figure 10

Drosophila Shaker (GI:288442) (SEQ ID NO: 1)
MAAVAGLYGLGEDRQHRKKQQQQQQHQKEQLEQKEEQKKIAERKLQLREQQLQRNSLDGYGSLPKLSSQDEEGGAGH
GFGGGPQHFEPIPHDHDFCERVVINVSGLRFETQLRTLNQFPDTLLGDPARRLRYFDPLRNEYFFDRSRPSFDAILY
YYQSGGRLRRPVNVPLDVFSEEIKFYELGDQAINKFREDEGFIKEEERPLPDNEKQRKVWLLFEYPESSQAARVVAI
ISVFVILLSIVIFCLETLPEFKHYKVFNTTTNGTKIEEDEVPDITDPFFLIETLCIIWFTFELTVRFLACPNKLNFC
RDVMNVIDIIAIIPYFITLATVVAEEEDTLNLPKAPVSPQDKSSNQAMSLAILRVIRLVRVFRIFKLSRHSKGLQIL
GRTLKASMRELGLLIFFLFIGVVLFSSAVYFAEAGSENSFFKSIPDAFWWAVVTMTTVGYGDMTPVGVWGKIVGSLC
AIAGVLTIALPVPVIVSNFNYFYHRETDQEEMQSQNFNHVTSCPYLPGTLGQHMKKSSLSESSSDMMDLDDGVESTP
GLTETHPGRSAVAPFLGAQQQQQQQPVASSLSMSIDKQLQHPLQHVTQTQLYQQQQQQQQQQQNGFKQQQQQTQQQL
QQQQSHTINASAAAATSGSGSSGLTMRHNNALAVSIETDV human Na$_v$ 1.1 (HGNC: SCN1A) (SWISS-PROT: P35498) (SEQ ID NO: 2)
MEQTVLVPPGPDSFNFFTRESLAAIERRIAEEKAKNPKPDKKDDDENGPKPNSDLEAGKNLPFIYGDIPPEMVSEPL
EDLDPYYINKKTFIVLNKGKAIFRFSATSALYILTPFNPLRKIAIKILVHSLFSMLIMCTILTNCVFMTMSNPPDWT
KNVEYTFTGIYTFESLIKIIARGFCLEDFTFLRDPWNWLDFTVITFAYVTEFVDLGNVSALRTFRVLRALKTISVIP
GLKTIVGALIQSVKKLSDVMILTVFCLSVFALIGLQLFMGNLRNKCIQWPPTNASLEEHSIEKNITVNYNGTLINET
VFEFDWKSYIQDSRYHYFLEGFLDALLCGNSSDAGQCPEGYMCVKAGRNPNYGYTSFDTFSWAFLSLFRLMTQDFWE
NLYQLTLRAAGKTYMIFFVLVIFLGSFYLINLILAVVAMAYEEQNQATLEEAEQKEAEFQQMIEQLKKQQEAAQQAA
TATASEHSREPSAAGRLSDSSSEASKLSSKSAKERRNRRKKRKQKEQSGGEEKDEDEFQKSESEDSIRRKGFRFSIE
GNRLTYEKRYSSPHQSLLSIRGSLFSPRRNSRTSLFSFRGRAKDVGSENDFADDEHSTFEDNESRRDSLFVPRRHGE
RRNSNLSQTSRSSRMLAVFPANGKMHSTVDCNGVVSLVGGPSVPTSPVGQLLPEVIIDKPATDDNGTTTETEMRKRR
SSSFHVSMDFLEDPSQRQRAMSIASILTNTVEELEESRQKCPPCWYKFSNIFLIWDCSPYWLKVKHVVNLVVMDPFV
DLAITICIVLNTLFMAMEHYPMTDHFNNVLTVGNLVFTGIFTAEMFLKIIAMDPYYYFQEGWNIFDGFIVTLSLVEL
GLANVEGLSVLRSFRLLRVFKLAKSWPTLNMLIKIIGNSVGALGNLTLVLAIIVFIFAVVGMQLFGKSYKDCVCKIA
SDCQLPRWHMNDFFHSFLIVFRVLCGEWIETMWDCMEVAGQAMCLTVFMMVMVIGNLVVLNLFLALLLSSFSADNLA
ATDDDNEMNNLQIAVDRMHKGVAYVKRKIYEFIQQSFIRKQKILDEIKPLDDLNNKKDSCMSNHTAEIGKDLDYLKD
VNGTTSGIGTGSSVEKYIIDESDYMSFINNPSLTVTVPIAVGESDFENLNTEDFSSESDLEESKEKLNESSSSSEGS
TVDIGAPVEEQPVVEPEETLEPEACFTEGCVQRFKCCQINVEEGRGKQWWNLRRTCFRIVEHNWFETFIVFMILLSS
GALAFEDIYIDQRKTIKTMLEYADKVFTYIFILEMLLKWVAYGYQTYFTNAWCWLDFLIVDVSLVSLTANALGYSEL
GAIKSLRTLRALRPLRALSRFEGMRVVVNALLGAIPSIMNVLLVCLIFWLIFSIMGVNLFAGKFYHCINTTTGDRFD
IEDVNNHTDCLKLIERNETARWKNVKVNFDNVGFGYLSLLQVATFKGWMDIMYAAVDSRNVELQPKYEESLYMYLYF
VIFIIFGSFFTLNLFIGVIIDNFNQQKKKFGGQDIFMTEEQKKYYNAMKKLGSKKPQKPIPRPGNKFQGMVFDFVTR
QVFDISIMILICLNMVTMMVETDDQSEYVTTILSRINLVFIVLFTGECVLKLISLRHYYFTIGWNIFDFVVVILSIV
GMFLAELIEKYFVSPTLFRVIRLARIGRILRLIKGAKGIRTLLFALMMSLPALFNIGLLLFLVMFIYAIFGMSNFAY
VKREVGIDDMFNFETFGNSMICLFQITTSAGWDGLLAPILNSKPPDCDPNKVNPGSSVKGDCGNPSVGIFFFVSYII
ISFLVVVNMYIAVILENFSVATEESAEPLSEDDFEMFYEVWEKFDPDATQFMEFEKLSQFAAALEPPLNLPQPNKLQ
LIAMDLPMVSGDRIHCLDILFAFTKRVLGESGEMDALRIQMEERFMASNPSKVSYQPITTTLKRKQEEVSAVIIQRA
YRRHLLKRTVKQASFTYNKNKIKGGANLLIKEDMIIDRINENSITEKTDLTMSTAACPPSYDRVTKPIVEKHEQEGK
DEKAKGK

Figure 14A human Na_v 1.2 (HGNC: *SCN2A*) (SWISS-PROT: Q99250) (SEQ ID NO: 3)

MAQSVLVPPGPDSFRFFTRESLAAIEQRIAEEKAKRPKQERKDEDDENGPKPNSDLEAGKSLPFIYGDIPPEMVSVP
LEDLDPYYINKKTFIVLNKGKAISRFSATPALYILTPFNPIRKLAIKILVHSLFNMLIMCTILTNCVFMTMSNPPDW
TKNVEYTFTGIYTFESLIKILARGFCLEDFTFLRDPWNWLDFTVITFAYVTEFVDLGNVSALRTFRVLRALKTISVI
PGLKTIVGALIQSVKKLSDVMILTVFCLSVFALIGLQLFMGNLRNKCLQWPPDNSSFEINITSFFNNSLDGNGTTFN
RTVSIFNWDEYIEDKSHFYFLEGQNDALLCGNSSDAGQCPEGYICVKAGRNPNYGYTSFDTFSWAFLSLFRLMTQDF
WENLYQLTLRAAGKTYMIFFVLVIFLGSFYLINLILAVVAMAYEEQNQATLEEAEQKEAEFQQMLEQLKKQQEEAQA
AAAAASAESRDFSGAGGIGVFSESSSVASKLSSKSEKELKNRRKKKKQKEQSGEEEKNDRVRKSESEDSIRRKGFRF
SLEGSRLTYEKRFSSPHQSLLSIRGSLFSPRRNSRASLFSFRGRAKDIGSENDFADDEHSTFEDNDSRRDSLFVPHR
HGERRHSNVSQASRASRVLPILPMNGKMHSAVDCNGVVSLVGGPSTLTSAGQLLPEGTTTETEIRKRRSSSYHVSMD
LLEDPTSRQRAMSIASILTNTMEELEESRQKCPPCWYKFANMCLIWDCCKPWLKVKHLVNLVVMDPFVDLAITICIV
LNTLFMAMEHYPMTEQFSSVLSVGNLVFTGIFTAEMFLKIIAMDPYYYFQEGWNIFDGFIVSLSLMELGLANVEGLS
VLRSFRLLRVFKLAKSWPTLNMLIKIIGNSVGALGNLTLVLAIIVFIFAVVGMQLFGKSYKECVCKISNDCELPRWH
MHDFFHSFLIVFRVLCGEWIETMWDCMEVAGQTMCLTVFMMVMVIGNLVVLNLFLALLLSSFSSDNLAATDDDNEMN
NLQIAVGRMQKGIDFVKRKIREFIQKAFVRKQKALDEIKPLEDLNNKKDSCISNHTTIEIGKDLNYLKDGNGTTSGI
GSSVEKYVVDESDYMSFINNPSLTVTVPIAVGESDFENLNTEEFSSESDMEESKEKLNATSSSEGSTVDIGAPAEGE
QPEVEPEESLEPEACFTEDCVRKFKCCQISIEEGKGKLWWNLRKTCYKIVEHNWFETFIVFMILLSSGALAFEDIYI
EQRKTIKTMLEYADKVFTYIFILEMLLKWVAYGFQVYFTNAWCWLDFLIVDVSLVSLTANALGYSELGAIKSLRTLR
ALRPLRALSRFEGMRVVVNALLGAIPSIMNVLLVCLIFWLIFSIMGVNLFAGKFYHCINYTTGEMFDVSVVNNYSEC
KALIESNQTARWKNVKVNFDNVGLGYLSLLQVATFKGWMDIMYAAVDSRNVELQPKYEDNLYMYLYFVIFIIFGSFF
TLNLFIGVIIDNFNQQKKKFGGQDIFMTEEQKKYYNAMKKLGSKKPQKPIPRPANKFQGMVFDFVTKQVFDISIMIL
ICLNMVTMMVETDDQSQEMTNILYWINLVFIVLFTGECVLKLISLRYYYFTIGWNIFDFVVVILSIVGMFLAELIEK
YFVSPTLFRVIRLARIGRILRLIKGAKGIRTLLFALMMSLPALFNIGLLLFLVMFIYAIFGMSNFAYVKREVGIDDM
FNFETFGNSMICLFQITTSAGWDGLLAPILNSGPPDCDPDKDHPGSSVKGDCGNPSVGIFFFVSYIIISFLVVVNMY
IAVILENFSVATEESAEPLSEDDFEMFYEVWEKFDPDATQFIEFAKLSDFADALDPPLLIAKPNKVQLIAMDLPMVS
GDRIHCLDILFAFTKRVLGESGEMDALRIQMEERFMASNPSKVSYEPITTTLKRKQEEVSAIIQRAYRRYLLKQKV
KKVSSIYKKDKGKECDGTPIKEDTLIDKLNENSTPEKTDMTPSTTSPPSYDSVTKPEKEKFEKDKSEKEDKGKDIRE
SKK

Figure 14B human Na$_v$ 1.3 (HGNC: *SCN3A*) (SWISS-PROT: Q9NY46) (SEQ ID NO: 4)

```
MAQALLVPPGPESFRLFTRESLAAIEKRAAEEKAKKPKKEQDNDDENKPKPNSDLEAGKNLPFIYGDIPPEMVSEPL
EDLDPYYINKKTFIVMNKGKAIFRFSATSALYILTPLNPVRKIAIKILVHSLFSMLIMCTILTNCVFMTLSNPPDWT
KNVEYTFTGIYTFESLIKILARGFCLEDFTFLRDPWNWLDFSVIVMAYVTEFVSLGNVSALRTFRVLRALKTISVIP
GLKTIVGALIQSVKKLSDVMILTVFCLSVFALIGLQLFMGNLRNKCLQWPPSDSAFETNTTSYFNGTMDSNGTFVNV
TMSTFNWKDYIGDDSHFYVLDGQKDPLLCGNGSDAGQCPEGYICVKAGRNPNYGYTSFDTFSWAFLSLFRLMTQDYW
ENLYQLTLRAAGKTYMIFFVLVIFLGSFYLVNLILAVVAMAYEEQNQATLEEAEQKEAEFQQMLEQLKKQQEEAQAV
AAASAASRDFSGIGGLGELLESSSEASKLSSKSAKEWRNRRKKRRQREHLEGNNKGERDSFPKSESEDSVKRSSFLF
SMDGNRLTSDKKFCSPHQSLLSIRGSLFSPRRNSKTSIFSFRGRAKDVGSENDFADDEHSTFEDSESRRDSLFVPHR
HGERRNSNVSQASMSSRMVPGLPANGKMHSTVDCNGVVSLVGGPSALTSPTGQLPPEGTTTETEVRKRRLSSYQISM
EMLEDSSGRQRAVSIASILTNTMEELEESRQKCPPCWYRFANVFLIWDCCDAWLKVKHLVNLIVMDPFVDLAITICI
VLNTLFMAMEHYPMTEQFSSVLTVGNLVFTGIFTAEMVLKIIAMDPYYYFQEGWNIFDGIIVSLSLMELGLSNVEGL
SVLRSFRLLRVFKLAKSWPTLNMLIKIIGNSVGALGNLTLVLAIIVFIFAVVGMQLFGKSYKECVCKINDDCTLPRW
HMNDFFHSFLIVFRVLCGEWIETMWDCMEVAGQTMCLIVFMLVMVIGNLVVLNLFLALLLSSFSSDNLAATDDDNEM
NNLQIAVGRMQKGIDYVKNKMRECFQKAFFRKPKVIEIHEGNKIDSCMSNNTGIEISKELNYLRDGNGTTSGVGTGS
SVEKYVIDENDYMSFINNPSLTVTVPIAVGESDFENLNTEEFSSESELEESKEKLNATSSSEGSTVDVVLPREGEQA
ETEPEEDLKPEACFTEGCIKKFPFCQVSTEEGKGKIWWNLRKTCYSIVEHNWFETFIVFMILLSSGALAFEDIYIEQ
RKTIKTMLEYADKVFTYIFILEMLLKWVAYGFQTYFTNAWCWLDFLIVDVSLVSLVANALGYSELGAIKSLRTLRAL
RPLRALSRFEGMRVVVNALVGAIPSIMNVLLVCLIFWLIFSIMGVNLFAGKFYHCVNMTTGNMFDISDVNNLSDCQA
LGKQARWKNVKVNFDNVGAGYLALLQVATFKGWMDIMYAAVDSRDVKLQPVYEENLYMYLYFVIFIIFGSFFTLNLF
IGVIIDNFNQQKKKFGGQDIFMTEEQKKYYNAMKKLGSKKPQKPIPRPANKFQGMVFDFVTRQVFDISIMILICLNM
VTMMVETDDQGKYMTLVLSRINLVFIVLFTGEFVLKLVSLRHYYFTIGWNIFDFVVVILSIVGMFLAEMIEKYFVSP
TLFRVIRLARIGRILRLIKGAKGIRTLLFALMMSLPALFNIGLLLFLVMFIYAIFGMSNFAYVKKEAGIDDMFNFET
FGNSMICLFQITTSAGWDGLLAPILNSAPPDCDPDTIHPGSSVKGDCGNPSVGIFFFVSYIIISFLVVVNMYIAVIL
ENFSVATEESAEPLSEDDFEMFYEVWEKFDPDATQFIEFSKLSDFAAALDPPLLIAKPNKVQLIAMDLPMVSGDRIH
CLDILFAFTKRVLGESGEMDALRIQMEDRFMASNPSKVSYEPITTTLKRKQEEVSAAIIQRNFRCYLLKQRLKNISS
NYNKEAIKGRIDLPIKQDMIIDKLNGNSTPEKTDGSSSTTSPPSYDSVTKPDKEKFEKDKPEKESKGKEVRENQK
```

Figure 14C human Na_v 1.4 (HGNC: *SCN4A*) (GENBANK TRANSLATION: M81758) (SEQ ID NO: 5)

MARPSLCTLARLGPECLRPFTRESLAAIEQRAVEEEARLQRNKQMEIEEPERKPRSDLEAGKNLPMIYGDPPPEVIG
IPLEDLDPYYSNKKTFIVLNKGKAIFRFSATPALYLLSPFSVVRRGAIKVLIHALFSMFIMITILTNCVFMTMSDPP
PWSKNVEYTFTGIYTFESLIKILARGFCVDDFTFLRDPWNWLDFSVIMMAYLTEFVDLGNISALRTFRVLRALKTIT
VIPGLKTIVGALIQSVKKLSDVMILTVFCLSVFALVGLQLFMGNLRQKCVRWPPPFNDTNTTWYSNDTWYGNDTWYG
NEMWYGNDSWYANDTWNSHASWATNDTFDWDAYISDEGNFYFLEGSNDALLCGNSSDAGHCPKGYECIKTGRNPNYG
YTSYDTFSWAFLALFRLMTQDYWENLFQLTLRAAGKTYMIFFVVIIFLGSFYLINLILAVVAMAYAEQNEATLAEDK
EKEEEFQQMLEKFKKHQEELEKAKAAQALEGGEADGDPAHGKDCNGSLDTSQGEKGAPRQSGSGDSGISDAMEELEE
AHQKCPPWWYKCAHKVLIWDCCAPWLKFKNIIHLIVMDPFVDLGITICIVLNTLFMAMEHYPMTEHFDNVLTVGNLV
FTGIFTAEMVLKLIAMDPYEYFQQGWNIFDSIIVTLSLVELGLANVQGLSVLRSFRLLRVFKLAKSWPTLNMLIKII
GNSVGALGNLTLVLAIIVFIFAVVGMQLFGKSYKECVCKIALDCNLPRWHMHDFFHSFLIVFRILCGEWIETMWDCM
EVAGQAMCLTVFLMVMVIGNLVVLNLFLALLLSSFSADSLAASDEDGEMNNLQIAIGRIKLGIGFAKAFLLGLLHGK
ILSPKDIMLSLGEADGAGEAGEAGETAPEDEKKEPPEEDLKKDNHILNHMGLADGPPSSLELDHLNFINNPYLTIQV
PIASEESDLEMPTEEETDTFSEPEDSKKPPQPLYDGNSSVCSTADYKPPEEDPEEQAEENPEGEQPEECFTEACVQR
WPCLYVDISQGRGKKWWTLRRACFKIVEHNWFETFIVFMILLSSGALAFEDIYIEQRRVIRTILEYADKVFTYIFIM
EMLLKWVAYGFKVYFTNAWCWLDFLIVDVSIISLVANWLGYSELGPIKSLRTLRALRPLRALSRFEGMRVVVNALLG
AIPSIMNVLLVCLIFWLIFSIMGVNLFAGKFYYCINTTTSERFDISEVNNKSECESLMHTGQVRWLNVKVNYDNVGL
GYLSLLQVATFKGWMDIMYAAVDSREKEEQPQYEVNLYMYLYFVIFIIFGSFFTLNLFIGVIIDNFNQQKKKLGGKD
IFMTEEQKKYYNAMKKLGSKKPQKPIPRPQNKIQGMVYDLVTKQAFDITIMILICLNMVTMMVETDDQSQLKVDILY
NINMIFIIIFTGECVLKMLALRQYYFTVGWNIFDFVVVILSIVGLALSDLIQKYFVSPTLFRVIRLARIGRVLRLIR
GAKGIRTLLFALMMSLPALFNIGLLLFLVMFIYSIFGMSNFAYVKKESGIDDMFNFETFGNSIICLFEITTSAGWDG
LLNPILNSGPPDCDPNLENPGTSVKGDCGNPSIGICFFCSYIIISFLIVVNMYIAIILENFNVATEESSEPLGEDDF
EMFYETWEKFDPDATQFIAYSRLSDFVDTLQEPLRIAKPNKIKLITLDLPMVPGDKIHCLDILFALTKEVLGDSGEM
DALKQTMEEKFMAANPSKVSYEPITTTLKRKHEEVCAIKIQRAYRRHLLQRSMKQASYMYRHSHDGSGDDAPEKEGL
LANTMSKMYGHENGNSSSPSPEEKGEAGDAGPTMGLMPISPSDTAWPPAPPPGQTVRPGVKESLV

Figure 14D human Nav 1.5 (HGNC: *SCN5a*) (SWISS-PROT: Q14524) (SEQ ID NO: 6)

MANFLLPRGTSSFRRFTRESLAAIEKRMAEKQARGSTTLQESREGLPEEEAPRPQLDLQASKKLPDLYGNPPQELIG
EPLEDLDPFYSTQKTFIVLNKGKTIFRFSATNALYVLSPFHPIRRAAVKILVHSLFNMLIMCTILTNCVFMAQHDPP
PWTKYVEYTFTAIYTFESLVKILARGFCLHAFTFLRDPWNWLDFSVIIMAYTTEFVDLGNVSALRTFRVLRALKTIS
VISGLKTIVGALIQSVKKLADVMVLTVFCLSVFALIGLQLFMGNLRHKCVRNFTALNGTNGSVEADGLVWESLDLYL
SDPENYLLKNGTSDVLLCGNSSDAGTCPEGYRCLKAGENPDHGYTSFDSFAWAFLALFRLMTQDCWERLYQQTLRSA
GKIYMIFFMLVIFLGSFYLVNLILAVVAMAYEEQNQATIAETEEKEKRFQEAMEMLKKEHEALTIRGVDTVSRSSLE
MSPLAPVNSHERRSKRRKRMSSGTEECGEDRLPKSDSEDGPRAMNHLSLTRGLSRTSMKPRSSRGSIFTFRRRDLGS
EADFADDENSTAGESESHHTSLLVPWPLRRTSAQGQPSPGTSAPGHALHGKKNSTVDCNGVVSLLGAGDPEATSPGS
HLLRPVMLEHPPDTTTPSEEPGGPQMLTSQAPCVDGFEEPGARQPALSAVSVLTSALEELEESRHKCPPCWNRLAQR
YLIWECCPLWMSIKQGVKLVVMDPFTDLTITMCIVLNTLFMALEHYNMTSEFEEMLQVGNLVFTGIFTAEMTFKIIA
LDPYYYFQQGWNIFDSIIVILSLMELGLSRMSNLSVLRSFRLLRVFKLAKSWPTLNTLIKIIGNSVGALGNLTLVLA
IIVFIFAVVGMQLFGKNYSELRDSDSGLLPRWHMMDFFHAFLIIFRILCGEWIETMWDCMEVSGQSLCLLVFLLVMV
IGNLVVLNLFLALLLSSFSADNLTAPDEDREMNNLQLALARIQRGLRFVKRTTWDFCCGLLRQRPQKPAALAAQGQL
PSCIATPYSPPPPETEKVPPTRKETRFEEGEQPGQGTPGDPEPVCVPIAVAESDTDDQEEDEENSLGTEEESSKQQE
SQPVSGGPEAPPDSRTWSQVSATASSEAEASASQADWRQQWKAEPQAPGCGETPEDSCSEGSTADMTNTAELLEQIP
DLGQDVKDPEDCFTEGCVRRCPCCAVDTTQAPGKVWWRLRKTCYHIVEHSWFETFIIFMILLSSGALAFEDIYLEER
KTIKVLLEYADKMFTYVFVLEMLLKWVAYGFKKYFTNAWCWLDFLIVDVSLVSLVANTLGFAEMGPIKSLRTLRALR
PLRALSRFEGMRVVVNALVGAIPSIMNVLLVCLIFWLIFSIMGVNLFAGKFGRCINQTEGDLPLNYTIVNNKSQCES
LNLTGELYWTKVKVNFDNVGAGYLALLQVATFKGWMDIMYAAVDSRGYEEQPQWEYNLYMYIYFVIFIIFGSFFTLN
LFIGVIIDNFNQQKKKLGGQDIFMTEEQKKYYNAMKKLGSKKPQKPIPRPLNKYQGFIFDIVTKQAFDVTIMFLICL
NMVTMMVETDDQSPEKINILAKINLLFVAIFTGECIVKLAALRHYYFTNSWNIFDFVVVILSIVGTVLSDIIQKYFF
SPTLFRVIRLARIGRILRLIRGAKGIRTLLFALMMSLPALFNIGLLLFLVMFIYSIFGMANFAYVKWEAGIDDMFNF
QTFANSMLCLFQITTSAGWDGLLSPILNTGPPYCDPTLPNSNGSRGDCGSPAVGILFFTTYIIISFLIVVNMYIAII
LENFSVATEESTEPLSEDDFDMFYEIWEKFDPEATQFIEYSVLSDFADALSEPLRIAKPNQISLINMDLPMVSGDRI
HCMDILFAFTKRVLGESGEMDALKIQMEEKFMAANPSKISYEPITTTLRRKHEEVSAMVIQRAFRRHLLQRSLKHAS
FLFRQQAGSGLSEEDAPEREGLIAYVMSENFSRPLGPPSSSSISSTSFPPSYDSVTRATSDNLQVRGSDYSHSEDLA
DFPPSPDRDRESIV

Figure 14E human Na_v 1.6 (HGNC: *SCN8A*) (SWISS-PROT: O95788) (SEQ ID NO: 7)

MAARLLAPPGPDSFKPFTPESLANIERRIAESKLKKPPKADGSHREDDEDSKPKPNSDLEAGKSLPFIYGDIPQGLV
AVPLEDFDPYYLTQKTFVVLNRGKTLFRFSATPALYILSPFNLIRRIAIKILIHSVFSMIIMCTILTNCVFMTFSNP
PDWSKNVEYTFTGIYTFESLVKIIARGFCIDGFTFLRDPWNWLDFSVIMMAYITEFVNLGNVSALRTFRVLRALKTI
SVIPGLKTIVGALIQSVKKLSDVMILTVFCLSVFALIGLQLFMGNLRNKCVVWPINFNESYLENGTKGFDWEEYINN
KTNFYTVPGMLEPLLCGNSSDAGQCPEGYQCMKAGRNPNYGYTSFDTFSWAFLALFRLMTQDYWENLYQLTLRAAGK
TYMIFFVLVIFVGSFYLVNLILAVVAMAYEEQNQATLEEAEQKEAEFKAMLEQLKKQQEEAQAAAMATSAGTVSEDA
IEEEGEEGGGSPRSSSEISKLSSKSAKERRNRRKKRKQKELSEGEEKGDPEKVFKSESEDGMRRKAFRLPDNRIGRK
FSIMNQSLLSIPGSPFLSRHNSKSSIFSFRGPGRFRDPGSENEFADDEHSTVEESEGRRDSLFIPIRARERRSSYSG
YSGYSQGSRSSRIFPSLRRSVKRNSTVDCNGVVSLIGGPGSHIGGRLLPEATTEVEIKKKGPGSLLVSMDQLASYGR
KDRINSIMSVVTNTLVEELEESQRKCPPCWYKFANTFLIWECHPYWIKLKEIVNLIVMDPFVDLAITICIVLNTLFM
AMEHHPMTPQFEHVLAVGNLVFTGIFTAEMFLKLIAMDPYYYFQEGWNIFDGFIVSLSLMELSLADVEGLSVLRSFR
LLRVFKLAKSWPTLNMLIKIIGNSVGALGNLTLVLAIIVFIFAVVGMQLFGKSYKECVCKINQDCELPRWHMHDFFH
SFLIVFRVLCGEWIETMWDCMEVAGQAMCLIVFMMVMVIGNLVVLNLFLALLLSSFSADNLAATDDDGEMNNLQISV
IRIKKGVAWTKLKVHAFMQAHFKQREADEVKPLDELYEKKANCIANHTGADIHRNGDFQKNGNGTTSGIGSSVEKYI
IDEDHMSFINNPNLTVRVPIAVGESDFENLNTEDVSSESDPEGSKDKLDDTSSSEGSTIDIKPEVEEVPVEQPEEYL
DPDACFTEGCVQRFKCCQVNIEEGLGKSWWILRKTCFLIVEHNWFETFIIFMILLSSGALAFEDIYIEQRKTIRTIL
EYADKVFTYIFILEMLLKWTAYGFVKFFTNAWCWLDFLIVAVSLVSLIANALGYSELGAIKSLRTLRALRPLRALSR
FEGMRVVVNALVGAIPSIMNVLLVCLIFWLIFSIMGVNLFAGKYHYCFNETSEIRFEIEDVNNKTECEKLMEGNNTE
IRWKNVKINFDNVGAGYLALLQVATFKGWMDIMYAAVDSRKPDEQPKYEDNIYMYIYFVIFIIFGSFFTLNLFIGVI
IDNFNQQKKKFGGQDIFMTEEQKKYYNAMKKLGSKKPQKPIPRPLNKIQGIVFDFVTQQAFDIVIMMLICLNMVTMM
VETDTQSKQMENILYWINLVFVIFFTCECVLKMFALRHYYFTIGWNIFDFVVVILSIVGMFLADIIEKYFVSPTLFR
VIRLARIGRILRLIKGAKGIRTLLFALMMSLPALFNIGLLLFLVMFIFSIFGMSNFAYVKHEAGIDDMFNFETFGNS
MICLFQITTSAGWDGLLLPILNRPPDCSLDKEHPGSGFKGDCGNPSVGIFFFVSYIIISFLIVVNMYIAIILENFSV
ATEESADPLSEDDFETFYEIWEKFDPDATQFIEYCKLADFADALEHPLRVPKPNTIELIAMDLPMVSGDRIHCLDIL
FAFTKRVLGDSGELDILRQQMEERFVASNPSKVSYEPITTTLRRKQEEVSAVVLQRAYRGHLARRGFICKKTTSNKL
ENGGTHREKKESTPSTASLPSYDSVTKPEKEKQQRAEEGRRERAKRQKEVRESKC

Figure 14F human Na$_v$1.7 (HGNC: *SCN9A*) (GENBANK TRANSLATION: X82835) (SEQ ID NO: 8)

MAMLPPPGPQSFVHFTKQSLALIEQRIAERKSKEPKEEKKDDDEEAPKPSSDLEAGKQLPFIYGDIPPGMVSEPLED
LDPYYADKKTFIVLNKGKTIFRFNATPALYMLSPFSPLRRISIKILVHSLFSMLIMCTILTNCIFMTMNNPPDWTKN
VEYTFTGIYTFESLVKILARGFCVGEFTFLRDPWNWLDFVVIVFAYLTEFVNLGNVSALRTFRVLRALKTISVIPGL
KTIVGALIQSVKKLSDVMILTVFCLSVFALIGLQLFMGNLKHKCFRNSLENNETLESIMNTLESEEDFRKYFYYLEG
SKDALLCGFSTDSGQCPEGYTCVKIGRNPDYGYTSFDTFSWAFLALFRLMTQDYWENLYQQTLRAAGKTYMIFFVVV
IFLGSFYLINLILAVVAMAYEEQNQANIEEAKQKELEFQQMLDRLKKEQEEAEAIAAAAAEYTSIRRSIMGLSESS
SETSKLSSKSAKERRNRRKKKNQKKLSSGEEKGDAEKLSKSESEDSIRRKSFHLGVEGHRPAHEKRLSTPNQSPLSI
RGSLFSARRSSRTSLFSFKGRGRDIGSETEFADDEHSIFGDNESRRGSLFVPHRPQERRSSNISQASRSPPMLPVNG
KMHSAVDCNGVVSLVDGRSALMLPNGQLLPEGTTNQIHKKRRCSSYLLSEDMLNDPNLRQRAMSRASILTNTVEELE
ESRQKCPPWWYRFAHKFLIWNCSPYWIKFKKCIYFIVMDPFVDLAITICIVLNTLFMAMEHHPMTEEFKNVLAIGNL
VFTGIFAAEMVLKLIAMDPYEYFQVGWNIFDSLIVTLSLVELFLADVEGLSVLRSFRLLRVFKLAKSWPTLNMLIKI
IGNSVGALGNLTLVLAIIVFIFAVVGMQLFGKSYKECVCKINDDCTLPRWHMNDFFHSFLIVFRVLCGEWIETMWDC
MEVAGQAMCLIVYMMVMVIGNLVVLNLFLALLLSSFSSDNLTAIEEDPDANNLQIAVTRIKKGINYVKQTLREFILK
AFSKKPKISREIRQAEDLNTKKENYISNHTLAEMSKGHNFLKEKDKISGFGSSVDKHLMEDSDGQSFIHNPSLTVTV
PIAPGESDLENMNAEELSSDSDSEYSKVRLNRSSSSECSTVDNPLPGEGEEAEAEPMNSDEPEACFTDGCVRRFSCC
QVNIESGKGKIWWNIRKTCYKIVEHSWFESFIVLMILLSSGALAFEDIYIERKKTIKIILEYADKIFTYIFILEMLL
KWIAYGYKTYFTNAWCWLDFLIVDVSLVTLVANTLGYSDLGPIKSLRTLRALRPLRALSRFEGMRVVVNALIGAIPS
IMNVLLVCLIFWLIFSIMGVNLFAGKFYECINTTDGSRFPASQVPNRSECFALMNVSQNVRWKNLKVNFDNVGLGYL
SLLQVATFKGWTIIMYAAVDSVNVDKQPKYEYSLYMYIYFVVFIIFGSFFTLNLFIGVIIDNFNQQKKKLGGQDIFM
TEEQKKYYNAMKKLGSKKPQKPIPRPGNKIQGCIFDLVTNQAFDISIMVLICLNMVTMMVEKEGQSQHMTEVLYWIN
VVFIILFTGECVLKLISLRHYYFTVGWNIFDFVVVIISIVGMFLADLIETYFVSPTLFRVIRLARIGRILRLVKGAK
GIRTLLFALMMSLPALFNIGLLLFLVMFIYAIFGMSNFAYVKKEDGINDMFNFETFGNSMICLFQITTSAGWDGLLA
PILNSKPPDCDPKKVHPGSSVEGDCGNPSVGIFYFVSYIIISFLVVVNMYIAVILENFSVATEESTEPLSEDDFEMF
YEVWEKFDPDATQFIEFSKLSDFAAALDPPLLIAKPNKVQLIAMDLPMVSGDRIHCLDILFAFTKRVLGESGEMDSL
RSQMEERFMSANPSKVSYEPITTTLKRKQEDVSATVIQRAYRRYRLRQNVKNISSIYIKDGDRDDDLLNKKDMAFDN
VNENSSPEKTDATSSTTSPPSYDSVTKPDKEKYEQDRTEKEDKGKDSKESKK

Figure 14G human Nav 1.8 (HGNC: *SCN10A*) (SWISS-PROT: Q9Y5Y9) (SEQ ID NO: 9)

```
MEFPIGSLETNNFRRFTPESLVEIEKQIAAKQGTKKAREKHREQKDQEEKPRPQLDLKACNQLPKFYGELPAELIGE
PLEDLDPFYSTHRTFMVLNKGRTISRFSATRALWLFSPFNLIRRTAIKVSVHSWFSLFITVTILVNCVCMTRTDLPE
KIEYVFTVIYTFEALIKILARGFCLNEFTYLRDPWNWLDFSVITLAYVGTAIDLRGISGLRTFRVLRALKTVSVIPG
LKVIVGALIHSVKKLADVTILTIFCLSVFALVGLQLFKGNLKNKCVKNDMAVNETTNYSSHRKPDIYINKRGTSDPL
LCGNGSDSGHCPDGYICLKTSDNPDFNYTSFDSFAWAFLSLFRLMTQDSWERLYQQTLRTSGKIYMIFFVLVIFLGS
FYLVNLILAVVTMAYEEQNQATTDEIEAKEKKFQEALEMLRKEQEVLAALGIDTTSLHSHNGSPLTSKNASERRHRI
KPRVSEGSTEDNKSPRSDPYNQRRMSFLGLASGKRRASHGSVFHFRSPGRDISLPEGVTDDGVFPGDHESHRGSLLL
GGGAGQQGPLPRSPLPQPSNPDSRHGEDEHQPPPTSELAPGAVDVSAFDAGQKKTFLSAEYLDEPFRAQRAMSVVSI
ITSVLEELEESEQKCPPCLTSLSQKYLIWDCCPMWVKLKTILFGLVTDPFAELTITLCIVVNTIFMAMEHHGMSPTF
EAMLQIGNIVFTIFFTAEMVFKIIAFDPYYYFQKKWNIFDCIIVTVSLLELGVAKKGSLSVLRSFRLLRVFKLAKSW
PTLNTLIKIIGNSVGALGNLTIILAIIVFVFALVGKQLLGENYRNNRKNISAPHEDWPRWHMHDFFHSFLIVFRILC
GEWIENMWACMEVGQKSICLILFLTVMVLGNLVVLNLFIALLLNSFSADNLTAPEDDGEVNNLQVALARIQVFGHRT
KQALCSFFSRSCPFPQPKAEPELVVKLPLSSSKAENHIAANTARGSSGGLQAPRGPRDEHSDFIANPTVWVSVPIAE
GESDLDDLEDDGGEDAQSFQQEVIPKGQQEQLQQVERCGDHLTPRSPGTGTSSEDLAPSLGETWKDESVPQVPAEGV
DDTSSSEGSTVDCLDPEEILRKIPELADDLEEPDDCFTEGCIRHCPCCKLDTTKSPWDVGWQVRKTCYRIVEHSWFE
SFIIFMILLSSGSLAFEDYYLDQKPTVKALLEYTDRVFTFIFVFEMLLKWVAYGFKKYFTNAWCWLDFLIVNISLIS
LTAKILEYSEVAPIKALRTLRALRPLRALSRFEGMRVVVDALVGAIPSIMNVLLVCLIFWLIFSIMGVNLFAGKFWR
CINYTDGEFSLVPLSIVNNKSDCKIQNSTGSFFWVNVKVNFDNVAMGYLALLQVATFKGWMDIMYAAVDSREVNMQP
KWEDNVYMYLYFVIFIIFGGFFTLNLFVGVIIDNFNQQKKKLGGQDIFMTEEQKKYYNAMKKLGSKKPQKPIPRPLN
KFQGFVFDIVTRQAFDITIMVLICLNMITMMVETDDQSEEKTKILGKINQFFVAVFTGECVMKMFALRQYYFTNGWN
VFDFIVVVLSIASLIFSAILKSLQSYFSPTLFRVIRLARIGRILRLIRAAKGIRTLLFALMMSLPALFNIGLLLFLV
MFIYSIFGMSSFPHVRWEAGIDDMFNFQTFANSMLCLFQITTSAGWDGLLSPILNTGPPYCDPNLPNSNGTRGDCGS
PAVGIIFFTTYIIISFLIMVNMYIAVILENFNVATEESTEPLSEDDFDMFYETWEKFDPEATQFITFSALSDFADTL
SGPLRIPKPNRNILIQMDLPLVPGDKIHCLDILFAFTKNVLGESGELDSLKANMEEKFMATNLSKSSYEPIATTLRW
KQEDISATVIQKAYRSYVLHRSMALSNTPCVPRAEEEAASLPDEGFVAFTANENCVLPDKSETASATSFPPSYESVT
RGLSDRVNMRTSSSIQNEDEATSMELIAPGP
```

Figure 14H human Na_v 1.9 (HGNC: *SCN11A*) (SWISS-PROT: Q9UHE0) (SEQ ID NO: 10)

MDDRCYPVIFPDERNFRPFTSDSLAAIEKRIAIQKEKKKSKDQTGEVPQPRFQLDLKASPKLPKLYGDIPRELIGKP
LEDLDPFYRNHKTFMVLNRKRTIYRFSAKHALFIFGPFNSIRSLAIRVSVHSLFSMFIIGTVIINCVFMATGPAKNS
NSNNTDIAECVFTGIYIFEALIKILARGFILDEFSFLRDPWNWLDSIVIGIAIVSYIPGITIKLLPLRTFRVFRALK
AISVVSRLKVIVGALLRSVKKLVNVIILTFFCLSIFALVGQQLFMGSLNLKCISRDCKNISNPEAYDHCFEKKENSP
EFKMCGIWMGNSACSIQYECKHTKINPDYNYTNFDNFGWSFLAMFRLMTQDSWEKLYQQTLRTTGLYSVFFFIVVIF
LGSFYLINLTLAVVTMAYEEQNKNVAAEIEAKEKMFQEAQQLLKEEKEALVAMGIDRSSLTSLETSYFTPKKRKLFG
NKKRKSFFLRESGKDQPPGSDSDEDCQKKPQLLEQTKRLSQNLSLDHFDEHGDPLQRQRALSAVSILTITMKEQEKS
QEPCLPCGENLASKYLVWNCCPQWLCVKKVLRTVMTDPFTELAITICIIINTVFLAMEHHKMEASFEKMLNIGNLVF
TSIFIAEMCLKIIALDPYHYFRRGWNIFDSIVALLSFADVMNCVLQKRSWPFLRSFRVLRVFKLAKSWPTLNTLIKI
IGNSVGALGSLTVVLVIVIFIFSVVGMQLFGRSFNSQKSPKLCNPTGPTVSCLRHWHMGDFWHSFLVVFRILCGEWI
ENMWECMQEANASSSLCVIVFILITVIGKLVVLNLFIALLLNSFSNEERNGNLEGEARKTKVQLALDRFRRAFCFVR
HTLEHFCHKWCRKQNLPQQKEVAGGCAAQSKDIIPLVMEMKRGSETQEELGILTSVPKTLGVRHDWTWLAPLAEEED
DVEFSGEDNAQRITQPEPEQQAYELHQENKKPTSQRVQSVEIDMFSEDEPHLTIQDPRKKSDVTSILSECSTIDLQD
GFGWLPEMVPKKQPERCLPKGFGCCFPCCSVDKRKPPWVIWWNLRKTCYQIVKHSWFESFIIFVILLSSGALIFEDV
HLENQPKIQELLNCTDIIFTHIFILEMVLKWVAFGFGKYFTSAWCCLDFIIVIVSVTTLINLMELKSFRTLRALRPL
RALSQFEGMKVVVNALIGAIPAILNVLLVCLIFWLVFCILGVYFFSGKFGKCINGTDSVINYTIITNKSQCESGNFS
WINQKVNFDNVGNAYLALLQVATFKGWMDIIYAAVDSTEKEQQPEFESNSLGYIYFVVFIIFGSFFTLNLFIGVIID
NFNQQQKKLGGQDIFMTEEQKKYYNAMKKLGSKKPQKPIPRPLNKCQGLVFDIVTSQIFDIIIISLIILNMISMMAE
SYNQPKAMKSILDHLNWVFVVIFTLECLIKIFALRQYYFTNGWNLFDCVVVLLSIVSTMISTLENQEHIPFPPTLFR
IVRLARIGRILRLVRAARGIRTLLFALMMSLPSLFNIGLLLFLIMFIYAILGMNWFSKVNPESGIDDIFNFKTFASS
MLCLFQISTSAGWDSLLSPMLRSKESCNSSSENCHLPGIATSYFVSYIIISFLIVVNMYIAVILENFNTATEESEDP
LGEDDFDIFYEVWEKFDPEATQFIKYSALSDFADALPEPLRVAKPNKYQFLVMDLPMVSEDRLHCMDILFAFTARVL
GGSDGLDSMKAMMEEKFMEANPLKKLYEPIVTTTKRKEEERGAAIIQKAFRKYMMKVTKGDQGDQNDLENGPHSPLQ
TLCNGDLSSFGVAKGKVHCD

Figure 14I human Ca$_v$1.1 (HGNC: *CACNA1S*) (GENBANK TRANSLATION: L33798) (SEQ ID NO: 11)

MEPSSPQDEGLRKKQPKKPVPEILPRPPRALFCLTLENPLRKACISIVEWKPFETIILLTIFANCVALAVYLPMPED
DNNSLNLGLEKLEYFFLIVFSIEAAMKIIAYGFLFHQDAYLRSGWNVLDFTIVFLGVFTVILEQVNVIQSHTAPMSS
KGAGLDVKALRAFRVLRPLRLVSGVPSLQVVLNSIFKAMLPLFHIALLVLFMVIIYAIIGLELFKGKMHKTCYFIGT
DIVATVENEEPSPCARTGSGRRCTINGSECRGGCPGPNHGITHFDNFGFSMLTVYQCITMEGWTDVLYWVNDAIGNE
WPWIYFVTLILLGSFFILNLVLGVLSGEFTKEREKAKSRGTFQKLREKQQLDEDLRGYMSWITQGEVMDVEDFREGK
LSLDEGGSDTESLYEIAGLNKIIQFIRHWRQWNRIFRWKCHDIVKSKVFYWLVILIVALNTLSIASEHHNQPHWLTR
LQDIANRVLLSLFTTEMLMKMYGLGLRQYFMSIFNRFDCFVVCSGILEILLVESGAMTPLGISVLRCIRLLRIFKIT
KYWTSLSNLVASLLNSIRSIASLLLLLFLFIVIFRLLGMQLFGGRYDFEDTEVRRSNFDNFPQALISVFQVLTGEDW
TSMMYNGIMASSGPSYPGMLVCIYFIILFVCGNYILLNVFLAIAVDNLAEAESLTSAQKAKAEEKKRRKMSKGLPDK
SEEEKSTMAKKLEQKPKGEGIPTTAKLKIDEFESNVNEVKDPYPSADFPGDDEEDEPEIPLSPRPRPLAELQLKEKA
VPIPEASSFFIFSPTNKIRVLCHRIVNATWFTNFILLFILLSSAALAAEDPIRADSMRNQILKHFDIGFTSVFTVEI
VLKMTTYGAFLHKGSFCRNYFNMLDLLVVAVSLISMGLESSAISVVKILRVLRVLRPLRAINRAKGLKHVARCMFVA
ISTIGNIVLVTTLLQFMFACIGVQLFKGKFFRCTDLSKMTEEECRGYYYVYKDGDPMQIELRHREWVHSDFHFDNVL
SAMMSLFTVSTFEGWPQLLYKAIDSNAEDVGPIYNNRVEMAIFFIIYIILIAFFMMNIFVGFVIVTFQEQGETEYKN
CELDKNQRQCVQYALKARPLRCYIPKNPYQYQVWYIVTSSYFEYLMFALIMLNTICLGMQHYNQSEQMNHISDILNV
AFTIIFTLEMILKLMAFKARGYFGNPWNVFDFLIVIGSIIDVILSEIDTFLASSGGLYCLGGGCGNVDPDESARISS
AFFRLFRVMRLIKLLSRAEGVRTLLWTFIKSFQALPYVALLIVMLFFIYAVIGMQMFGKIALVDGTQINRNNNFQTF
PQAVLLLFRCATGEAWQEILLACSYGKLCDPESDYAPGEEYTCGTNFAYYYFISFYMLCAFLVINLFVAVIMDNFDY
LTRDWSILGPHHLDEFKAIWAEYDPEAKGRIKHLDVVTLLRRIQPPLGFGKFCPHRVACKRLVGMNMPLNSDGTVTF
NATLFALVRTALKIKTEGNFEQANEELRAIIKKIWKRTSMKLLDQVIPPIGDDEVTVGKFYATFLIQEHFRKFMKRQ
EEYYGYRPKKDIVQIQAGLRTIEEEAAPEICRTVSGDLAAEEELERAMVEAAMEEGIFRRTGGLFGQVDNFLERTNS
LPPVMANQRPLQFAEIEMEEMESPVFLEDFPQDPRTNPLARANTNNANANVAYANSNHSNSHVFSSVHYEREFPEET
ETPATRGRALGQPCRSLGPHSKPCVEMLKGLLTQRAMPRGQAPPAPCQCPRVESSMPEDRKSSTPGSLHEETPHSRS
TRENTSRCSAPATALLIQKALVRGGLGTLAADANFIMATGQALGDACQMEPEEVEIMATELLKGREAPDGMASSLGC
LNLGSSLGSLDQHQGSQETLIPPRL

Figure 14J human Ca_v1.2 (HGNC: CACNA1C) (GENBANK TRANSLATION: L29529) (SEQ ID NO: 12)
MNANAAAGLAPEHIPTPGAALSWQAAIDAARQAKLMGSAGNATISTVSSTQRKRRQYGKPKKQGSTTATRPPRALLC
LTLKNPIRRACISIVEWKPFEIIILLTIFANCVALAIYIPFPEDDSNATNSNLERVEYLFLIIFTVEAFLKVIAYGL
LFHPNAYLRNGWNLLDFIIVVVGLFSAILEQATKADGANALGGKGAGFDVKALRAFRVLRPLRLVSGVPSLQVVLNS
IIKAMVPLLHIALLVLFVIIIYAIIGLELFMGKMHKTCYNQEGIADVPAEDDPSPCALETGHGRQCQNGTVCKPGWD
GPKHGITNFDNFAFAMLTVFQCITMEGWTDVLYWMQDAMGYELPWVYFVSLVIFGSFFVLNLVLGVLSGEFSKEREK
AKARGDFQKLREKQQLEEDLKGYLDWITQAEDIDPENEDEGMDEEKPRNMSMPTSETESVNTENVAGGDIEGENCGA
RLAHRISKSKFSRYWRRWNRFCRRKCRAAVKSNVFYWLVIFLVFLNTLTIASEHYNQPNWLTEVQDTANKALLALFT
AEMLLKMYSLGLQAYFVSLFNRFDCFVVCGGILETILVETKIMSPLGISVLRCVRLLRIFKITRYWNSLSNLVASLL
NSVRSIASLLLLLFLFIIIFSLLGMQLFGGKFNFDEMQTRRSTFDNFPQSLLTVFQILTGEDWNSVMYDGIMAYGGP
SFPGMLVCIYFIILFICGNYILLNVFLAIAVDNLADAESLTSAQKEEEEEKERKKLARTASPEKKQELVEKPAVGES
KEEKIELKSITADGESPPATKINMDDLQPNENEDKSPYPNPETTGEEDEEEPEMPVGPRPRPLSELHLKEKAVPMPE
ASAFFIFSSNNRFRLQCHRIVNDTIFTNLILFFILLSSISLAAEDPVQHTSFRNHILFYFDIVFTTIFTIEIALKMT
AYGAFLHKGSFCRNYFNILDLLVVSVSLISFGIQSSAINVVKILRVLRVLRPLRAINRAKGLKHVVQCVFVAIRTIG
NIVIVTTLLQFMFACIGVQLFKGKLYTCSDSSKQTEAECKGNYITYKDGEVDHPIIQPRSWENSKFDFDNVLAAMMA
LFTVSTFEGWPELLYRSIDSHTEDKGPIYNYRVEISIFFIIYIIIAFFMMNIFVGFVIVTFQEQGEQEYKNCELDK
NQRQCVEYALKARPLRRYIPKNQHQYKVWYVVNSTYFEYLMFVLILLNTICLAMQHYGQSCLFKIAMNILNMLFTGL
FTVEMILKLIAFKPKHYFCDAWNTFDALIVVGSIVDIAITEVNNAEENSRISITFFRLFRVMRLVKLLSRGEGIRTL
LWTFIKSFQALPYVALLIVMLFFIYAVIGMQVFGKIALNDTTEINRNNNFQTFPQAVLLLFRCATGEAWQDIMLACM
PGKKCAPESEPSNSTEGETPCGSSFAVFYFISFYMLCAFLIINLFVAVIMDNFDYLTRDWSILGPHHLDEFKRIWAE
YDPEAKGRIKHLDVVTLLRRIQPPLGFGKLCPHRVACKRLVSMNMPLNSDGTVMFNATLFALVRTALRIKTEGNLEQ
ANEELRAIIKKIWKRTSMKLLDQVVPPAGDDEVTVGKFYATFLIQEYFRKFKKRKEQGLVGKPSQRNALSLQAGLRT
LHDIGPEIRRAISGDLTAEEELDKAMKEAVSAASEDDIFRRAGGLFGNHVSYYQSDGRSAFPQTFTTQRPLHINKAG
SSQGDTESPSHEKLVDSTFTPSSYSSTGSNANINNANNTALGRLPRPAGYPSTVSTVEGHGPPLSPAIRVQEVAWKL
SSNRMHCCDMLDGGTFPPALGPRRAPPCLHQQLQGSLAGLREDTPCIVPGHASLCCSSRVGEWLPAGCTAPQHARCH
SRESQAAMAGQEETSQDETYEVKMNHDTEACSEPSLLSTEMLSYQDDENRQLTLPEEDKRDIRQSPKRGFLRSASLG
RRASFHLECLKRQKDRGGDISQKTVLPLHLVHHQALAVAGLSPLLQRSHSPASFPRPFATPPATPGSRGWPPQPVPT
LRLEGVESSEKLNSSFPSIHCGSWAETTPGGGGSSAARRVRPVSLMVPSQAGAPGRQFHGSASSLVEAVLISEGLGQ
FAQDPKFIEVTTQELADACDMTIEEMESAADNILSGGAPQSPNGALLPFVNCRDAGQDRAGGEEDAGCVRARGRPSE
EELQDSRVYVSSL

Figure 14K human Ca<sub>v</sub>1.3 (HGNC: *CACNA1D*) (GENBANK TRANSLATION: M76558) (SEQ ID NO: 13)

```
MMMMMMMKKMQHQRQQQADHANEANYARGTRLPLSGEGPTSQPNSSKQTVLSWQAAIDAARQAKAAQTMSTSAPPPV
GSLSQRKRQQYAKSKKQGNSSNSRPARALFCLSLNNPIRRACISIVEWKPFDIFILLAIFANCVALAIYIPFPEDDS
NSTNHNLEKVEYAFLIIFTVETFLKIIAYGLLLHPNAYVRNGWNLLDFVIVIVGLFSVILEQLTKETEGGNHSSGKS
GGFDVKALRAFRVLRPLRLVSGVPSLQVVLNSIIKAMVPLLHIALLVLFVIIIYAIIGLELFIGKMHKTCFFADSDI
VAEEDPAPCAFSGNGRQCTANGTECRSGWVGPNGGITNFDNFAFAMLTVFQCITMEGWTDVLYWMNDAMGFELPWVY
FVSLVIFGSFFVLNLVLGVLSGEFSKEREKAKARGDFQKLREKQQLEEDLKGYLDWITQAEDIDPENEEEGGEEGKR
NTSMPTSETESVNTENVSGEGENRGCCGSLCQAISKSKLSRRWRRWNRFNRRRCRAAVKSVTFYWLVIVLVFLNTLT
ISSEHYNQPDWLTQIQDIANKVLLALFTCEMLVKMYSLGLQAYFVSLFNRFDCFVVCGGITETILVELEIMSPLGIS
VFRCVRLLRIFKVTRHWTSLCNLVASLLNSMKSSASLLLLLFLFIIIFSLLGMQLFGGKFNFDETQTKRSTFDNFPQ
ALLTVFQILTGEDWNAVMYDGIMAYGGPSSSGMIVCIYFIILFICGNYILLNVFLAIAVDNLADAESLNTAQKEEAE
EKERKKIARKESLENKKNNKPEVNQIANSDNKVTIDDYREEDEDKDPYPPCDVPVGEEEEEEEEDEPEVPAGPRPRR
ISELNMKEKIAPIPEGSAFFILSKTNPIRVGCHKLINHHIFTNLILVFIMLSSAALAAEDPIRSHSFRNTILGYFDY
AFTAIFTVEILLKMTTFGAFLHKGAFCRNYFNLLDMLVVGVSLVSFGIQSSAISVVKILRVLRVLRPLRAINRAKGL
KHVVQCVFVAIRTIGNIMIVTTLLQFMFACIGVQLFKGKFYRCTDEAKSNPEECRGLFILYKDGDVDSPVVRERIWQ
NSDFNFDNVLSAMMALFTVSTFEGWPALLYKAIDSNGENIGPIYNHRVEISIFFIIYIIIVAFFMMNIFVGFVIVTF
QEQGEKEYKNCELDKNQRQCVEYALKARPLRRYIPKNPYQYKFWYVVNSSPFEYMMFVLIMLNTLCLAMQHYEQSKM
FNDAMDILNMVFTGVFTVEMVLKVIAFKPKGYFSDAWNTFDSLIVIGSIIDVALSEADPTESENVPVPTATPGNSEE
SNRISITFFRLFRVMRLVKLLSRGEGIRTLLWTFIKFFQALPYVALLIAMLFFIYAVIGMQMFGKVAMRDNNQINRN
NNFQTFPQAVLLLFRCATGEAWQEIMLACLPGKLCDPESDYNPGEEHTCGSNFAIVYFISFYMLCAFLIINLFVAVI
MDNFDYLTRDWSILGPHHLDEFKRIWSEYDPEAKGRIKHLDVVTLLRRIQPPLGFGKLCPHRVACKRLVAMNMPLNS
DGTVMFNATLFALVRTALKIKTEGNLEQANEELRAVIKKIWKKTSMKLLDQVVPPAGDDEVTVGKFYATFLIQDYFR
KFKKRKEQGLVGKYPAKNTTIALQAGLRTLHDIGPEIRRAISCDLQDDEPEETKREEEDDVFKRNGALLGNHVNHVN
SDRRDSLQQTNTTHRPLHVQRPSIPPASDTEKPLFPPAGNSVCHNHHNHNSIGKQVPTSTNANLNNANMSKAAHGKR
PSIGNLEHVSENGHHSSHKHDREPQRRSSVKRTRYYETYIRSDSGDEQLPTICREDPEIHGYFRDPHCLGEQEYFSS
EECYEDDSSPTWSRQNYGYYSRYPGRNIDSERPRGYHHPQGFLEDDDSPVCYDSRRSPRRRLLPPTPASHRRSSFNF
ECLRRQSSQEEVPSSPIFPHRTALPLHLMQQQIMAVAGLDSSKAQKYSPSHSTRSWATPPATPPYRDWTPCYTPLIQ
VEQSEALDQVNGSLPSLHRSSWYTDEPDISYRTFTPASLTVPSSFRNKNSDKQRSADSLVEAVLISEGLGRYARDPK
FVSATKHEIADACDLTIDEMESAASTLLNGNVRPRANGDVGPLSHRQDYELQDFGPGYSDEEPDPGRDEEDLADEMI
CITTL
```

Figure 14L human Ca$_v$1.4 (HGNC: *CACNA1F*) (GENBANK TRANSLATION: AJ224874) (SEQ ID NO: 14)

```
MSESEGGKDTTPEPSPANGAGPGPEWGLCPGPPAVEGESSGASGLGTPKRRNQHSKHKTVAVASAQRSPRALFCLTL
ANPLRRSCISIVEWKPFDILILLTIFANCVALGVYIPFPEDDSNTANHNLEQVEYVFLVIFTVETVLKIVAYGLVLH
PSAYIRNGWNLLDFIIVVVGLFSVLLEQGPGRPGDAPHTGGKPGGFDVKALRAFRVLRPLRLVSGVPSLHIVLNSIM
KALVPLLHIALLVLFVIIIYAIIGLELFLGRMHKTCYFLGSDMEAEEDPSPCASSGSGRACTLNQTECRGRWPGPNG
GITNFDNFFFAMLTVFQCVTMEGWTDVLYWMQDAMGYELPWVYFVSLVIFGSFFVLNLVLGVLSGEFSKEREKAKAR
GDFQKQREKQQMEEDLRGYLDWITQAEELDMEDPSADDNLGPQLAELTNRRRGRLRWFSHSTRSTHSTSSHASLPAS
DTGSMTETQGDEDEEEGALASCTRCLNKIMKTRVCRRLRRANRVLRARCRRAVKSNACYWAVLLLVFLNTLTIASEH
HGQPVWLTQIQEYANKVLLCLFTVEMLLKLYGLGPSAYVSSFFNRFDCFVVCGGILETTLVEVGAMQPLGISVLRCV
RLLRIFKVTRHWASLSNLVASLLNSMKSIASLLLLLFLFIIIFSLLGMQLFGGKFNFDQTHTKRSTFDTFPQALLTV
FQILTGEDWNVVMYDGIMAYGGPFFPGMLVCIYFIILFICGNYILLNVFLAIAVDNLASGDAGTAKDKGGEKSNEKD
LPQENEGLVPGVEKEEEEGARREGADMEEEEEEEEEEEEEEEGAGGVELLQEVVPKEKVVPIPEGSAFFCLSQTN
PLRKGCHTLIHHHVFTNLILVFIILSSVSLAAEDPIRAHSFRNHILGYFDYAFTSIFTVEILLKMTVFGAFLHRGSF
CRSWFNMLDLLVVSVSLISFGIHSSAISVVKILRVLRVLRPLRAINRAKGLKHVVQCVFVAIRTIGNIMIVTTLLQF
MFACIGVQLFKGKFYTCTDEAKHTPQECKGSFLVYPDGDVSRPLVRERLWVNSDFNFDNVLSAMMALFTVSTFEGWP
ALLYKAIDAYAEDHGPIYNYRVEISVFFIVYIIIAFFMMNIFVGFVIITFRAQGEQEYQNCELDKNQRQCVEYALK
AQPLRRYIPKNPHQYRVWATVNSAAFEYLMFLLILLNTVALAMQHYEQTAPFNYAMDILNMVFTGLFTIEMVLKIIA
FKPKHYFTDAWNTFDALIVVGSIVDIAVTEVNNGGHLGESSEDSSRISITFFRLFRVMRLVKLLSKGEGIRTLLWTF
IKSFQALPYVALLIAMIFFIYAVIGMQMFGKVALQDGTQINRNNNFQTFPQAVLLLFRCATGEAWQEIMLASLPGNR
CDPESDFGPGEEFTCGSNFAIAYFISFFMLCAFLIINLFVAVIMDNFDYLTRDWSILGPHHLDEFKRIWSEYDPGAK
GRIKHLDVVALLRRIQPPLGFGKLCPHRVACKRLVAMNMPLNSDGTVTFNATLFALVRTSLKIKTEGNLEQANQELR
IVIKKIWKRMKQKLLDEVIPPPDEEEVTVGKFYATFLIQDYFRKFRRRKEKGLLGNDAAPSTSSALQAGLRSLQDLG
PEMRQALTCDTEEEEEEGQEGVEEEDEKDLETNKATMVSQPSARRGSGISVSLPVGDRLPDSLSFGPSDDDRGTPTS
SQPSVPQAGSNTHRRGSGALIFTIPEEGNSQPKGTKGQNKQDEDEEVPDRLSYLDEQAGTPPCSVLLPPHRAQRYMD
GHLVPRRRLLPPTPAGRKPSFTIQCLQRQGSCEDLPIPGTYHRGRNSGPNRAQGSWATPPQRGRLLYAPLLLVEEGA
AGEGYLGRSSGPLRTFTCLHVPGTHSDPSHGKRGSADSLVEAVLISEGLGLFARDPRFVALAKQEIADACRLTLDEM
DNAASDLLAQGTSSLYSDEESILSRFDEEDLGDEMACVHAL
```

Figure 14M

**human Ca_v2.1 (HGNC: *CACNA1A*) (GENBANK TRANSLATION: AF004883) (SEQ ID NO: 15)**

MARFGDEMPARYGGGGSGAAAGVVVGSGGGRGAGGSRQGGQPGAQRMYKQSMAQRARTMALYNPIPVRQNCLTVNRS
LFLFSEDNVVRKYAKKITEWPPFEYMILATIIANCIVLALEQHLPDDDKTPMSERLDDTEPYFIGIFCFEAGIKIIA
LGFAFHKGSYLRNGWNVMDFVVVLTGILATVGTEFDLRTLRAVRVLRPLKLVSGIPSLQVVLKSIMKAMIPLLQIGL
LLFFAILIFAIIGLEFYMGKFHTTCFEEGTDDIQGESPAPCGTEEPARTCPNGTKCQPYWEGPNNGITQFDNILFAV
LTVFQCITMEGWTDLLYNSNDASGNTWNWLYFIPLIIIGSFFMLNLVLGVLSGEFAKERERVENRRAFLKLRRQQQI
ERELNGYMEWISKAEEVILAEDETDGEQRHPFDGALRRTTIKKSKTDLLNPEEAEDQLADIASVGSPFARASIKSAK
LENSTFFHKKERRMRFYIRRMVKTQAFYWTVLSLVALNTLCVAIVHYNQPEWLSDFLYYAEFIFLGLFMSEMFIKMY
GLGTRPYFHSSFNCFDCGVIIGSIFEVIWAVIKPGTSFGISVLRALRLLRIFKVTKYWASLRNLVVSLLNSMKSIIS
LLFLLFLFIVVFALLGMQLFGGQFNFDEGTPPTNFDTFPAAIMTVFQILTGEDWNEVMYDGIKSQGGVQGGMVFSIY
FIVLTLFGNYTLLNVFLAIAVDNLANAQELTKVEADEQEEEEAANQKLALQKAKEVAEVSPLSAANMSIAVKEQQKN
QKPAKSVWEQRTSEMRKQNLLASREALYNEMDPDERWKAAYTRHLRPDMKTHLDRPLVVDPQENRNNNTNKSRAAEP
TVDQRLGQQRAEDFLRKQARYHDRARDPSGSAGLDARRPWAGSQEAELSREGPYGRESDHHAREGSLEQPGFWEGEA
ERGKAGDPHRRHVHRQGGSRESRSGSPRTGADGEHRRHRAHRRPGEEGPEDKAERRARHPEGSRPARGGEGEGEGPD
GGERRRRHRHGAPATYEGDARREDKERRHRRRKENQGSGVPVSGPNLSTTRPIQQDLGRQDPPLAEDIDNMKNNKLA
TAESAAPHGSLGHAGLPQSPAKMGNSTDPGPMLAIPAMATNPQNAASRRTPNNPGNPSNPGPPKTPENSLIVTNPSG
TQTNSAKTARKPDHTTVDIPPACPPPLNHTVVQVNKNANPDPLPKKEEEKKEEEEDDRGEDGPKPMPPYSSMFILST
TNPLRRLCHYILNLRYFEMCILMVIAMSSIALAAEDPVQPNAPRNNVLRYFDYVFTGVFTFEMVIKMIDLGLVLHQG
AYFRDLWNILDFIVVSGALVAFAFTGNSKGKDINTIKSLRVLRVLRPLKTIKRLPKLKAVFDCVVNSLKNVFNILIV
YMLFMFIFAVVAVQLFKGKFFHCTDESKEFEKDCRGKYLLYEKNEVKARDREWKKYEFHYDNVLWALLTLFTVSTGE
GWPQVLKHSVDATFENQGPSPGYRMEMSIFYVVYFVVFPFFFVNIFVALIIITFQEQGDKMMEEYSLEKNERACIDF
AISAKPLTRHMPQNKQSFQYRMWQFVVSPPFEYTIMAMIALNTIVLMMKFYGASVAYENALRVFNIVFTSLFSLECV
LKVMAFGILNYFRDAWNIFDFVTVLGSITDILVTEFGNPNNFINLSFLRLFRAARLIKLLRQGYTIRILLWTFVQSF
KALPYVCLLIAMLFFIYAIIGMQVFGNIGIDVEDEDSDEDEFQITEHNNFRTFFQALMLLFRSATGEAWHNIMLSCL
SGKPCDKNSGILTRECGNEFAYFYFVSFIFLCSFLMLNLFVAVIMDNFEYLTRDSSILGPHHLDEYVRVWAEYDPAA
WGRMPYLDMYQMLRHMSPPLGLGKKCPARVAYKRLLRMDLPVADDNTVHFNSTLMALIRTALDIKIAKGGADKQQMD
AELRKEMMAIWPNLSQKTLDLLVTPHKSTDLTVGKIYAAMMIMEYYRQSKAKKLQAMREEQDRTPLMFQRMEPPSPT
QEGGPGQNALPSTQLDPGGALMAHESGLKESPSWVTQRAQEMFQKTGTWSPEQGPPTDMPNSQPNSQSVEMREMGRD
GYSDSEHYLPMEGQGRAASMPRLPAENQPRRGRPRGNNLSTISDTSPMKRSASVLGPKARRLDDYSLERVPPEENQR
HHQRRRDRSHRASERSLGRYTDVDTGLGTDLSMTTQSGDLPSKERDQERGRPKDRKHRQHHHHHHHHHHPPPPDKDR
YAQERPDHGRARARDQRWSRSPSEGREHMAHRQ

Figure 14N human Ca<sub>v</sub>2.2 (HGNC: *CACN1B*) (GENBANK TRANSLATION: M94172) (SEQ ID NO: 16)

```
MVRFGDELGGRYGPGGGERARGGGAGGAGGPGPGGGLQFGQRVLYKQSIAQRARTMALYNPIPVKQNCFTVNRSLFV
FSEDNVVRKYAKRITEWPPFEYMILATIIANCIVLALEQHLPDGDKTPMSERLDDTEPYFIGIFCFEAGIKIIALGF
VFHKGSYLRNGWNVMDFVVVLTGILATAGTDFDLRTLRAVRVLRPLKLVSGIPSLQVVLKSIMKAMVPLLQIGLLLF
FAILMFAIIGLEFYMGKFHKACFPNSTDAEPVGDFPCGKEAPARLCEGDTECREYWPGPNFGITNFDNILFAILTVF
QCITMEGWTDILYNTNDAAGNTWNWLYFIPLIIIGSFFMLNLVLGVLSGEFAKERERVENRRAFLKLRRQQQIEREL
NGYLEWIFKAEEVMLAEEDRNAEEKSPLDVLKRAATKKSRNDLIHAEEGEDRFADLCAVGSPFARASLKSGKTESSS
YFRRKEKMFRFFIRRMVKAQSFYWVVLCVVALNTLCVAMVHYNQPRRLTTTLYFAEFVFLGLFLTEMSLKMYGLGPR
SYFRSSFNCFDFGVIVGSVFEVVWAAIKPGSSFGISVLRALRLLRIFKVTKYWSSLRNLVVSLLNSMKSIISLLFLL
FLFIVVFALLGMQLFGGQFNFQDETPTTNFDTFPAAILTVFQILTGEDWNAVMYHGIESQGGVSKGMFSSFYFIVLT
LFGNYTLLNVFLAIAVDNLANAQELTKDEEEMEEAANQKLALQKAKEVAEVSPMSAANISIAARQQNSAKARSVWEQ
RASQLRLQNLRASCEALYSEMDPEERLRFATTRHLRPDMKTHLDRPLVVELGRDGARGPVGGKARPEAAEAPEGVDP
PRRHHRHRDKDKTPAAGDQDRAEAPKAESGEPGAREERPRPHRSHSKEAAGPPEARSERGRGPGPEGGRRHHRRGSP
EEAAEREPRRHRAHRHQDPSKECAGAKGERRARHRGGPRAGPREAESGEEPARRHRARHKAQPAHEAVEKETTEKEA
TEKEAEIVEADKEKELRNHQPREPHCDLETSGTVTVGPMHTLPSTCLQKVEEQPEDADNQRNVTRMGSQPPDPNTIV
HIPVMLTGPLGEATVVPSGNVDLESQAEGKKEVEADDVMRSGPRPIVPYSSMFCLSPTNLLRRFCHYIVTMRYFEVV
ILVVIALSSIALAAEDPVRTDSPRNNALKYLDYIFTGVFTFEMVIKMIDLGLLLHPGAYFRDLWNILDFIVVSGALV
AFAFSGSKGKDINTIKSLRVLRVLRPLKTIKRLPKLKAVFDCVVNSLKNVLNILIVYMLFMFIFAVIAVQLFKGKFF
YCTDESKELERDCRGQYLDYEKEEVEAQPRQWKKYDFHYDNVLWALLTLFTVSTGEGWPMVLKHSVDATYEEQGPSP
GYRMELSIFYVVYFVVFPFFFVNIFVALIIITFQEQGDKVMSECSLEKNERACIDFAISAKPLTRYMPQNRQSFQYK
TWTFVVSPPFEYFIMAMIALNTVVLMMKFYDAPYEYELMLKCLNIVFTSMFSMECVLKIIAFGVLNYFRDAWNVFDF
VTVLGSITDILVTEIAETNNFINLSFLRLFRAARLIKLLRQGYTIRILLWTFVQSFKALPYVCLLIAMLFFIYAIIG
MQVFGNIALDDDTSINRHNNFRTFLQALMLLFRSATGEAWHEIMLSCLSNQACDEQANATECGSDFAYFYFVSFIFL
CSFLMLNLFVAVIMDNFEYLTRDSSILGPHHLDEFIRVWAEYDPAACGRISYNDMFEMLKHMSPPLGLGKKCPARVA
YKRLVRMNMPISNEDMTVHFTSTLMALIRTALEIKLAPAGTKQHQCDAELRKEISVVWANLPQKTLDLLVPPHKPDE
MTVGKVYAALMIFDFYKQNKTTRDQMQQAPGGLSQMGPVSLFHPLKATLEQTQPAVLRGARVFLRQKSSTSLSNGGA
IQNQESGIKESVSWGTQRTQDAPHEARPPLERGHSTEIPVGRSGALAVDVQMQSITRRGPDGEPQPGLESQGRAASM
PRLAAETQPVTDASPMKRSISTLAQRPRGTHLCSTTPDRPPPSQASSHHHHRCHRRRDRKQRSLEKGPSLSADMDG
APSSAVGPGLPPGEGPTGCRRERERRQEPGRSQERRQPSSSSSEKQRFYSCDRFGGREPPKPKPSLSSHPTSPTAGQ
EPGPHPQGSGSVNGSPLLSTSGASTPGRGGRRQLPQTPLTPRPSITYKTANSSPIHFAGAQTSLPAFSPGRLSRGLS
EHNALLQRDPLSQPLAPGSRIGSDPYLGQRLDSEASVHALPEDTLTFEEAVATNSGRSSRTSYVSSLTSQSHPLRRV
PNGYHCTLGLSSGGRARHSYHHPDQDHWC
```

Figure 14O

**human Ca_v2.3 (HGNC: *CACNA1E*) (GENBANK TRANSLATION: L29384) (SEQ ID NO: 17)**

```
MARFGEAVVARPGSGDGDSDQSRNRQGTPVPASGQAAAYKQTKAQRARTMALYNPIPVRQNCFTVNRSLFIFGEDNI
VRKYAKKLIDWPPFEYMILATIIANCIVLALEQHLPEDDKTPMSRRLEKTEPYFIGIFCFEAGIKIVALGFIFHKGS
YLRNGWNVMDFIVVLSGILATAGTHFNTHVDLRTLRAVRVLRPLKLVSGIPSLQIVLKSIMKAMVPLLQIGLLLFFA
ILMFAIIGLEFYSGKLHRACFMNNSGILEGFDPPHPCGVQGCPAGYECKDWIGPNDGITQFDNILFAVLTVFQCITM
EGWTTVLYNTNDALGATWNWLYFIPLIIIGSFFVLNLVLGVLSGEFAKERERVENRRAFMKLRRQQQIERELNGYRA
WIDKAEEVMLAEENKNAGTSALEVLRRATIKRSRTEAMTRDSSDEHCVDISSVGTPLARASIKSAKVDGVSYFRHKE
RLLRISIRHMVKSQVFYWIVLSLVALNTACVAIVHHNQPQWLTHLLYYAEFLFLGLFLLEMSLKMYGMGPRLYFHSS
FNCFDFGVTVGSIFEVVWAIFRPGTSFGISVLRALRLLRIFKITKYWASLRNLVVSLMSSMKSIISLLFLLFLFIVV
FALLGMQLFGGRFNFNDGTPSANFDTFPAAIMTVFQILTGEDWNEVMYNGIRSQGGVSSGMWSAIYFIVLTLFGNYT
LLNVFLAIAVDNLANAQELTKDEQEEEEAFNQKHALQKAKEVSPMSAPNMPSIERERRRPHHMSVWEQRTSQLRKHM
QMSSQEALNREEAPTMNPLNPLNPLSSLNPLNAHPSLYRRPRAIEGLALGLALEKFEEERISRGGSLKGDGGDRSSA
LDNQRTPLSLGQREPPWLARPCHGNCDPTQQEAGGGEAVVTFEDRARHRQSQRRSRHRRVRTEGKESSSASRSRSAS
QERSLDEAMPTEGEKDHELRGNHGAKEPTIQEERAQDLRRTNSLMVSRGSGLAGGLDEADTPLVLPHPELEVGKHVV
LTEQEPEGSSEQALLGNVQLDMGRVISQSEPDLSCITANTDKATTESTSVTVAIPDVDPLVDSTVVHISNKTDGEAS
PLKEAEIREDEEEVEKKKQKKEKRETGKAMVPHSSMFIFSTTNPIRRACHYIVNLRYFEMCILLVIAASSIALAAED
PVLTNSERNKVLRYFDYVFTGVFTFEMVIKMIDQGLILQDGSYFRDLWNILDFVVVVGALVAFALANALGTNKGRDI
KTIKSLRVLRVLRPLKTIKRLPKLKAVFDCVVTSLKNVFNILIVYKLFMFIFAVIAVQLFKGKFFYCTDSSKDTEKE
CIGNYVDHEKNKMEVKGREWKRHEFHYDNIIWALLTLFTVSTGEGWPQVLQHSVDVTEEDRGPSRSNRMEMSIFYVV
YFVVFPFFFVNIFVALIIITFQEQGDKMMEECSLEKNERACIDFAISAKPLTRYMPQNRHTFQYRVWHFVVSPSFEY
TIMAMIALNTVVLMMKYYSAPCTYELALKYLNIAFTMVFSLECVLKVIAFGFLNYFRDTWNIFDFITVIGSITEIIL
TDSKLVNTSGFNMSFLKLFRAARLIKLLRQGYTIRILLWTFVQSFKALPYVCLLIAMLFFIYAIIGMQVFGNIKLDE
ESHINRHNNFRSFFGSLMLLFRSATGEAWQEIMLSCLGEKGCEPDTTAPSGQNENERCGTDLAYVYFVSFIFFCSFL
MLNLFVAVIMDNFEYLTRDSSILGPHHLDEFVRVWAEYDRAACGRIHYTEMYEMLTLMSPPLGLGKRCPSKVAYKRL
VLMNMPVAEDMTVHFTSTLMALIRTALDIKIAKGGADRQQLDSELQKETLAIWPHLSQKMLDLLVPMPKASDLTVGK
IYAAMMIMDYYKQSKVKKQRQQLEEQKNAPMFQRMEPSSLPQEIIANAKALFYLQQDPVSGLSGRSGYPSMSPLSPQ
DIFQLACMDPADDGQFQERQSLVVTDPSSMRRSFSTIRDKRSNSSWLEEFSMERSSENTYKSRRRSYHSSLRLSAHR
LNSDSGHKSDTHPSGGREPRRSKERKHLLSPDVSRCNSEERGTQADWESPERRQSRSPSEGRSQTPNRQGTGSLSES
SIPSVSDTSTPRRSRRQLPPVPPKPRPLLSYSSLIRHAGSISPPADGSEEGSPLTSQALESNNAWLTESSNSPHPQQ
RQHASPQRYISEPYLALHEDSHASDCVEEETLTFEAAVATSLGRSNTIGSAPPLRHSWQMPNGHYRRRRRGGPGPGM
MCGAVNNLLSDTEEDDKC
```

Figure 14P

**human Ca$_v$3.1 (HGNC: *CACNA1G*) (SWISS-PROT: O43497) (SEQ ID NO: 18)**

MDEEEDGAGAEEESGQPRSFMRLNDLSGAGGRPGPGSAEKDPGSADSEAEGLPYPALAPVVFFYLSQDSRPRSWCLRT
VCNPWFERISMLVILLNCVTLGMFRPCEDIACDSQRCRILQAFDDFIFAFFAVEMVVKMVALGIFGKKCYLGDTWNR
LDFFIVIAGMLEYSLDLQNVSFSAVRTVRVLRPLRAINRVPSMRILVTLLLDTLPMLGNVLLLCFFVFFIFGIVGVQ
LWAGLLRNRCFLPENFSLPLSVDLERYYQTENEDESPFICSQPRENGMRSCRSVPTLRGDGGGGPPCGLDYEAYNSS
SNTTCVNWNQYYTNCSAGEHNPFKGAINFDNIGYAWIAIFQVITLEGWVDIMYFVMDAHSFYNFIYFILLIIVGSFF
MINLCLVVIATQFSETKQRESQLMREQRVRFLSNASTLASFSEPGSCYEELLKYLVYILRKAARRLAQVSRAAGVRV
GLLSSPAPLGGQETQPSSSCSRSHRRLSVHHLVHHHHHHHHYHLGNGTLRAPRASPEIQDRDANGSRRLMLPPPST
PALSGAPPGGAESVHSFYHADCHLEPVRCQAPPPRSPSEASGRTVGSGKVYPTVHTSPPPETLKEKALVEVAASSGP
PTLTSLNIPPGFYSSMHKLLETQSTGACQSSCKISSPCLKADSGACGPDSCPYCARAGAGEVELADREMPDSDSEAV
YEFTQDAQHSDLRDPHSRRQRSLGPDAEPSSVLAFWRLICDTFRKIVDSKYFGRGIMIAILVNTLSMGIEYHEQPEE
LTNALEISNIVFTSLFALEMLLKLLVYGPFGYIKNPYNIFDGVIVVISVWEIVGQQGGGLSVLRTFRLMRVLKLVRF
LPALQRQLVVLMKTMDNVATFCMLLMLFIFIFSILGMHLFGCKFASERDGDTLPDRKNFDSLLWAIVTVFQILTQED
WNKVLYNGMASTSSWAALYFIALMTFGNYVLFNLLVAILVEGFQAEEISKREDASGQLSCIQLPVDSQGGDANKSES
EPDFFSPSLDGDGDRKKCLALVSLGEHPELRKSLLPPLIIHTAATPMSLPKSTSTGLGEALGPASRRTSSSGSAEPG
AAHEMKSPPSARSSPHSPWSAASSWTSRRSSRNSLGRAPSLKRRSPSGERRSLLSGEGQESQDEEESSEEERASPAG
SDHRHRGSLEREAKSSFDLPDTLQVPGLHRTASGRGSASEHQDCNGKSASGRLARALRPDDPPLDGDDADDEGNLSK
GERVRAWIRARLPACCLERDSWSAYIFPPQSRFRLLCHRIITHKMFDHVVLVIIFLNCITIAMERPKIDPHSAERIF
LTLSNYIFTAVFLAEMTVKVVALGWCFGEQAYLRSSWNVLDGLLVLISVIDILVSMVSDSGTKILGMLRVLRLLRTL
RPLRVISRAQGLKLVVETLMSSLKPIGNIVVICCAFFIIFGILGVQLFKGKFFVCQGEDTRNITNKSDCAEASYRWV
RHKYNFDNLGQALMSLFVLASKDGWVDIMYDGLDAVGVDQQPIMNHNPWMLLYFISFLLIVAFFVLNMFVGVVVENF
HKCRQHQEEEEARRREEKRLRRLEKKRRNLMLDDVIASGSSASAASEAQCKPYYSDYSRFRLLVHHLCTSHYLDLFI
TGVIGLNVVTMAMEHYQQPQILDEALKICNYIFTVIFVLESVFKLVAFGFRRFFQDRWNQLDLAIVLLSIMGITLEE
IEVNASLPINPTIIRIMRVLRIARVLKLLKMAVGMRALLDTVMQALPQVGNLGLLFMLLFFIFAALGVELFGDLECD
ETHPCEGLGRHATFRNFGMAFLTLFRVSTGDNWNGIMKDTLRDCDQESTCYNTVISPIYFVSFVLTAQFVLVNVVIA
VLMKHLEESNKEAKEEAELEAELELEMKTLSPQPHSPLGSPFLWPGVEGPDSPDSPKPGALHPAAHARSASHFSLEH
PTDRQLFDTISLLIQGSLEWELKLMDELAGPGGQPSAFPSAPSLGGSDPQIPLAEMEALSLTSEIVSEPSCSLALTD
DSLPDDMHTLLLSALESNMQPHPTELPGPDLLTVRKSGVSRTHSLPNDSYMCRHGSTAEGPLGHRGWGLPKAQSGSV
LSVHSQPADTSYILQLPKDAPHLLQPHSAPTWGTIPKLPPPGRSPLAQRPLRRQAAIRTDSLDVQGLGSREDLLAEV
SGPSPPLARAYSFWGQSSTQAQQHSRSHSKISKHMTPPAPCPGPEPNWGKGPPETRSSLELDTELSWISGDLLPPGG
QEEPPSPRDLKKCYSVEAQSCQRRPTSWLDEQRRHSIAVSCLDSGSQPHLGTDPSNLGGQPLGGPGSRPKKKLSPPS
ITIDPPESQGPRTPFSPGICLRRRAPSSDSKDPLASGPPDSMAASPSPKKDVLSLSGLSSDPADLDP

Figure 14Q human Ca,3.2 (HGNC: *CACNA1H*) (SWISS-PROT: O95180) (SEQ ID NO: 19)

```
MTEGARAADEVRVPLGAPPPGPAALVGASPESPGAPGREAERGSELGVSPSESPAAERGAELGADEEQRVPYPALAA
TVFFCLGQTTRPRSWCLRLVCNPWFEHVSMLVIMLNCVTLGMFRPCEDVECGSERCNILEAFDAFIFAFFAVEMVIK
MVALGLFGQKCYLGDTWNRLDFFIVVAGMMEYSLDGHNVSLSAIRTVRVLRPLRAINRVPSMRILVTLLLDTLPMLG
NVLLLCFFVFFIFGIVGVQLWAGLLRNRCFLDSAFVRNNNLTFLRPYYQTEEGEENPFICSSRRDNGMQKCSHIPGR
RELRMPCTLGWEAYTQPQAEGVGAARNACINWNQYYNVCRSGDSNPHNGAINFDNIGYAWIAIFQVITLEGWVDIMY
YVMDAHSFYNFIYFILLIIVGSFFMINLCLVVIATQFSETKQRESQLMREQRARHLSNDSTLASFSEPGSCYEELLK
YVGHIFRKVKPRSLRLYARWQSRWRKKVDPSAVQGQGPGHRQRRAGRHTASVHHLVYHHHHHHHHHYHFSHGSPRRP
GPEPGACDTRLVRAGAPPSPPSPGRGPPDAESVHSIYHADCHIEGPQERARVAHAAATAAASLRLATGLGTMNYPTI
LPSGVGSGKGSTSPGPKGKWAGGPPGTGGHGPLSLNSPDPYEKIPHVVGEHGLGQAPGHLSGLSVPCPLPSPPAGTL
TCELKSCPYCTRALEDPEGELSGSESGDSDGRGVYEFTQDVRHGDRWDPTRFPRATDTPGPGPGSPQRRAQQRAAPG
EPGWMGRLWVTFSGKLRRIVDSKYFSRGIMMAILVNTLSMGVEYHEQPEELTNALEISNIVFTSMFALEMLLKLLAC
GPLGYIRNPYNIFDGIIVVISVWEIVGQADGGLSVLRTFRLLRVLKLVRFLPALRRQLVVLVKTMDNVATFCTLLML
FIFIFSILGMHLFGCKFSLKTDTGDTVPDRKNFDSLLWAIVTVFQILTQEDWNVVLYNGMASTSSWAALYFVALMTF
GNYVLFNLLVAILVEGFQAEGDANRSDTDEDKTSVHFEEDFHKLRELQTTELKMCSLAVTPNGHLEGRGSLSPPLIM
CTAATPMPTPKSSPFLDAAPSLPDSRRGSSSSGDPPLGDQKPPASLRSSPCAPWGPSGAWSSRRSSWSSLGRAPSLK
RRGQCGERESLLSGEGKGSTDDEAEDGRAAPGPRATPLRRAESLDPRPLRPAALPPTKCRDRDGQVVALPSDFFLRI
DSHREDAAELDDDSEDSCCLRLHKVLEPYKPQWCRSREAWALYLFSPQNRFRVSCQKVITHKMFDHVVLVFIFLNCV
TIALERPDIDPGSTERVFLSVSNYIFTAIFVAEMMVKVVALGLLSGEHAYLQSSWNLLDGLLVLVSLVDIVVAMASA
GGAKILGVLRVLRLLRTLRPLRVISRAPGLKLVVETLISSLRPIGNIVLICCAFFIIFGILGVQLFKGKFYYCEGPD
TRNISTKAQCRAAHYRWVRRKYNFDNLGQALMSLFVLSSKDGWVNIMYDGLDAVGVDQQPVQNHNPWMLLYFISFLL
IVSFFVLNMFVGVVVENFHKCRQHQEAEEARRREEKRLRRLERRRRSTFPSPEAQRRPYYADYSPTRRSIHSLCTSH
YLDLFITFIICVNVITMSMEHYNQPKSLDEALKYCNYVFTIVFVFEAALKLVAFGFRRFFKDRWNQLDLAIVLLSLM
GITLEEIEMSAALPINPTIIRIMRVLRIARVLKLLKMATGMRALLDTVVQALPQVGNLGLLFMLLFFIYAALGVELF
GRLECSEDNPCEGLSRHATFSNFGMAFLTLFRVSTGDNWNGIMKDTLPECSREDKHCLSYLPALSPVYFVTFVLVAQ
FVLVNVVVAVLMKHLEESNKEAREDAELDAEIELEMAQGPGSARRVDADRPPLPQESPGAPDAPNLVARKVSVSRML
SLPNDSYMFRPVVPASAPHPRPLQEVEMETYGAGTPLGSVASVHSPPAESCASLQIPLAVSSPARSGEPLHALSPRG
TARSPSLSRLLCRQEAVHTDSLEGKIDSPRDTLDPAEPGEKTPVRPVTQGGSLQSPPRSPRPASVRTRKHTFGQRCV
SSRPAAPGGEEAEASDPADEEVSHITSSACPWQPTAEPHGPEASPVAGGERDLRRLYSVDAQGFLDKPGRADEQWRP
SAELGSGEPGEAKAWGPEAEPALGARRKKKMSPPCISVEPPAEDEGSARPSAAEGGSTTLRRRTPSCEATPHRDSLE
PTEGSGAGGDPAAKGERWGQASCRAEHLTVPSFAFEPLDLGVPSGDPFLDGSHSVTPESRASSSGAIVPLEPPESEP
PMPVGDPPEKRRGLYLTVPQCPLEKPGSPSATPAPGGGADDPV
```

Figure 14R human Ca_v3.3 (HGNC: CACNA1I) (GENBANK: AAM67414) (SEQ ID NO: 20)

```
MAESASPPSSSAAAPAAEPGVTTEQPGPRSPPSSPPGLEEPLDGADPHVPHPDLAPIAFFCLRQTTSPRNWCIKMVC
NPWFECVSMLVILLNCVTLGMYQPCDDMDCLSDRCKILQVFDDFIFIFFAMEMVLKMVALGIFGKKCYLGDTWNRLD
FFIVMAGMVEYSLDLQNINLSAIRTVRVLRPLKAINRVPSMRILVNLLLDTLPMLGNVLLLCFFVFFIFGIIGVQLW
AGLLRNRCFLEENFTIQGDVALPPYYQPEEDDEMPFICSLSGDNGIMGCHEIPPLKEQGRECCLSKDDVYDFGAGRQ
DLNASGLCVNWNRYYNVCRTGSANPHKGAINFDNIGYAWIVIFQVITLEGWVEIMYYVMDAHSFYNFIYFILLIIVG
SFFMINLCLVVIATQFSETKQREHRLMLEQRQRYLSSSTVASYAEPGDCYEEIFQYVCHILRKAKRRALGLYQALQS
RRQALGPEAPAPAKPGPHAKEPRHYQLCPQHSPLDATPHTLVQPIPATLASDPASCPCCQHEDGRRPSGLGSTDSGQ
EGSGSGSSAGGEDEADGDGARSSEDGASSELGKEEEEEEQADGAVWLCGDVWRETRAKLRGIVDSKYFNRGIMMAIL
VNTVSMGIEHHEQPEELTNILEICNVVFTSMFALEMILKLAAFGLFDYLRNPYNIFDSIIVIISIWEIVGQADGGLS
VLRTFRLLRVLKLVRFMPALRRQLVVLMKTMDNVATFCMLLMLFIFIFSILGMHIFGCKFSLRTDTGDTVPDRKNFD
SLLWAIVTVFQILTQEDWNVVLYNGMASTSPWASLYFVALMTFGNYVLFNLLVAILVEGFQAEGDANRSYSDEDQSS
SNIEEFDKLQEGLDSSGDPKLCPIPMTPNGHLDPSLPLGGHLGPAGAAGPAPRLSLQPDPMLVALGSRKSSVMSLGR
MSYDQRSLSSSRSSYYGPWGRSAAWASRRSSWNSLKHKPPSAEHESLLSAERGGGARVCEVAADEGPPRAAPLHTPH
AHHVHHGPHLAHRHRHHRPTLSLDNRDSVDLAELVPAVGAHPRAAWRAAGPAPGHEDCNGRMPSIAKDVFTKMGDRG
DRGEDEEEIDYTLCFRVRKMIDVYKPDWCEVREDWSVYLFSPENRFRVLCQTIIAHKLFDYVVLAFIFLNCITIALE
RPQIEAGSTERIFLTVSNYIFTAIFVGEMTLKVVSLGLYFGEQAYLRSSWNVLDGFLVFVSIIDIVVSLASAGGAKI
LGVLRVLRLLRTLRPLRVISRAPGLKLVVETLISSLKPIGNIVLICCAFFIIFGILGVQLFKGKFYHCLGVDTRNIT
NRSDCMAANYRWVHHKYNFDNLGQALMSLFVLASKDGWVNIMYNGLDAVAVDQQPVTNHNPWMLLYFISFLLIVSFF
VLNMFVGVVVENFHKCRQHQEAEEARRREEKRLRRLEKKRRKAQRLPYYATYCHTRLLIHSMCTSHYLDIFITFIIC
LNVVTMSLEHYNQPTSLETALKYCNYMFTTVFVLEAVLKLVAFGLRRFFKDRWNQLDLAIVLLSVMGITLEEIEINA
ALPINPTIIRIMRVLRIARVLKLLKMATGMRALLDTVVQALPQVGNLGLLFMLLFFIYAALGVELFGKLVCNDENPC
EGMSRHATFENFGMAFLTLFQVSTGDNWNGIMKDTLRDCTHDERSCLSSLQFVSPLYFVSFVLTAQFVLINVVVAVL
MKHLDDSNKEAQEDAEMDAELELEMAHGLGPGPRLPTGSPGAPGRGPGGAGGGGDTEGGLCRRCYSPAQENLWLDSV
SLIIKDSLEGELTIIDNLSGSIFHHYSSPAGCKKCHHDKQEVQLAETEAFSLNSDRSSSILLGDDLSLEDPTACPPG
RKDSKGELDPPEPMRVGDLGECFFPLSSTAVSPDPENFLCEMEEIPFNPVRSWLKHDSSQAPPSPFSPDASSPLLPM
PAEFFHPAVSASQKGPEKGTGTGTLPKIALQGSWASLRSPRVNCTLLRQATGSDTSLDASPSSSAGSLQTTLEDSLT
LSDSPRRALGPPAPAPGPRAGLSPAARRRLSLRGRGLFSLRGLRAHQRSHSSGGSTSPGCTHHDSMDPSDEEGRGGA
GGGGAGSEHSETLSSLSLTSLFCPPPPPPAPGLTPARKFSSTSSLAAPGRPHAAALAHGLARSPSWAADRSKDPPGR
APLPMGLGPLAPPPQPLPGELEPGDAASKRKR
```

Figure 14S

**human K$_v$1.1 (NCBI: *KCNA1*) (NCBI: NM_000217) (SEQ ID NO: 21)**
MTVMSGENVDEASAAPGHPQDGSYPRQADHDDHECCERVVINISGLRFETQLKTLAQFPNTLLGNPKKRMRYFDPLR
NEYFFDRNRPSFDAILYYYQSGGRLRRPVNVPLDMFSEEIKFYELGEEAMEKFREDEGFIKEEERPLPEKEYQRQVW
LLFEYPESSGPARVIAIVSVMVILISIVIFCLETLPELKDDKDFTGTVHRIDNTTVIYNSNIFTDPFFIVETLCIIW
FSFELVVRFFACPSKTDFFKNIMNFIDIVAIIPYFITLGTEIAEQEGNQKGEQATSLAILRVIRLVRVFRIFKLSRH
SKGLQILGQTLKASMRELGLLIFFLFIGVILFSSAVYFAEAEEAESHFSSIPDAFWWAVVSMTTVGYGDMYPVTIGG
KIVGSLCAIAGVLTIALPVPVIVSNFNYFYHRETEGEEQAQLLHVSSPNLASDSDLSRRSSSTMSKSEYMEIEEDMN
NSIAHYRQVNIRTANCTTANQNCVNKSKLLTDV

**human K$_v$1.2 (HGNC: *KCNA2*) (NCBI: NM_004974) (SEQ ID NO: 22)**
MTVATGDPADEAAALPGHPQDTYDPEADHECCERVVINISGLRFETQLKTLAQFPETLLGDPKKRMRYFDPLRNEYF
FDRNRPSFDAILYYYQSGGRLRRPVNVPLDIFSEEIRFYELGEEAMEMFREDEGYIKEEERPLPENEFQRQVWLLFE
YPESSGPARIIAIVSVMVILISIVSFCLETLPIFRDENEDMHGSGVTFHTYSNSTIGYQQSTSFTDPFFIVETLCII
WFSFEFLVRFFACPSKAGFFTNIMNIIDIVAIIPYFITLGTELAEKPEDAQQGQQAMSLAILRVIRLVRVFRIFKLS
RHSKGLQILGQTLKASMRELGLLIFFLFIGVILFSSAVYFAEADERESQFPSIPDAFWWAVVSMTTVGYGDMVPTTI
GGKIVGSLCAIAGVLTIALPVPVIVSNFNYFYHRETEGEEQAQYLQVTSCPKIPSSPDLKKSRSASTISKSDYMEIQ
EGVNNSNEDFREENLKTANCTLANTNYVNITKMLTDV

**human K$_v$1.3 (HGNC: *KCNA3*) (NCBI: NM_002232) (SEQ ID NO: 23)**
MDERLSLLRSPPPPSARHRAHPPQRPASSGGAHTLVNHGYAEPA
AGRELPPDMTVVPGDHLLEPEVADGGGAPPQGGCGGGGCDRYEPLPPSLPAAGEQDCCGERVVINISGLRFETQLKT
LCQFPETLLGDPKRRMRYFDPLRNEYFFDRNRPSFDAILYYYQSGGRIRRPVNVPIDIFSEEIRFYQLGEEAMEKFR
EDEGFLREEERPLFRRDFQRQVWLLFEYPESSGPARGIAIVSVLVILISIVIFCLETLPEFRDEKDYPASTSQDSFE
AAGNSTSGSRAGASSFSDPFFVVETLCIIWFSFELLVRFFACPSKATFSRNIMNLIDIVAIIPYFITLGTELAERQG
NGQQAMSLAILRVIRLVRVFRIFKLSRHSKGLQILGQTLKASMRELGLLIFFLFIGVILFSSAVYFAEADDPTSGFS
SIPDAFWWAVVTMTTVGYGDMHPVTIGGKIVGSLCAIAGVLTIALPVPVIVSNFNYFYHRETEGEEQSQYMHVGSCQ
HLSSSAEELRKARSNSTLSKSEYMVIEEGGMNHSAFPQTPFKTGNSTATCTTNNNPNSCVNIKKIFTDV

Figure 14T human K$_v$1.4 (HGNC: *KCNA4*) (NCBI: NM_002233) (SEQ ID NO: 24)
MEVAMVSAESSGCNSHMPYGYAAQARARERERLAHSRAAAAAAVAAATAAVEGSGGSGGGSHHHHQSRGACTSHDPQ
SSRGSRRRRRQRSEKKKAHYRQSSFPHCSDLMPSGSEEKILRELSEEEEDEEEEEEEEEGRFYYSEDDHGDECSYT
DLLPQDEGGGGYSSVRYSDCCERVVINVSGLRFETQMKTLAQFPETLLGDPEKRTQYFDPLRNEYFFDRNRPSFDAI
LYYYQSGGRLKRPVNVPFDIFTEEVKFYQLGEEALLKFREDEGFVREEEDRALPENEFKKQIWLLFEYPESSSPARG
IAIVSVLVILISIVIFCLETLPEFRDDRDLVMALSAGGHGGLLNDTSAPHLENSGHTIFNDPFFIVETVCIVWFSFE
FVVRCFACPSQALFFKNIMNIIDIVSILPYFITLGTDLAQQQGGGNGQQQQAMSFAILRIIRLVRVFRIFKLSRHSK
GLQILGHTLRASMRELGLLIFFLFIGVILFSSAVYFAEADEPTTHFQSIPDAFWWAVVTMTTVGYGDMKPITVGGKI
VGSLCAIAGVLTIALPVPVIVSNFNYFYHRETENEEQTQLTQNAVSCPYLPSNLLKKFRSSTSSSLGDKSEYLEMEE
GVKESLCAKEEKCQGKGDDSETDKNNCSNAKAVETDV human K$_v$1.5 (HGNC: *KCNA5*) (NCBI: NM_002234) (SEQ ID NO: 25)
MEIALVPLENGGAMTVRGGDEARAGCGQATGGELQCPFTAGLSDGPKEPAPKGRGAQRDADSGVRPLPPLPDPGVRP
LPPLPEELPRFPRRPPPEDEEEEGDPGLGTVEDQALGTASLHHQRVHINISGLRFETQLGTLAQFPNTLLGDPAKRLR
YFDPLRNEYFFDRNRPSFDGILYYYQSGGRLRRPVNVSLDVFADEIRFYQLGDEAMERFREDEGFIKEEEKPLPRNE
FQRQVWLIFEYPESSGSARAIAIVSVLVILISIITFCLETLPEFRDERELLRHPPAPHQPPAPAPGANGSGVMAPPS
GPTVAPLLPRTLADPFFIVETTCVIWFTFELLVRFFACPSKAGFSRNIMNIIDVVAIFPYFITLGTELAEQQPGGGG
GGQNGQQAMSLAILRVIRLVRVFRIFKLSRHSKGLQILGKTLQASMRELGLLIFFLFIGVILFSSAVYFAEADNQGT
HFSSIPDAFWWAVVTMTTVGYGDMRPITVGGKIVGSLCAIAGVLTIALPVPVIVSNFNYFYHRETDHEEPAVLKEEQ
GTQSQGPGLDRGVQRKVSGSRGSFCKAGGTLENADSARRGSCPLEKCNVKAKSNVDLRRSLYALCLDTSRETDL human K$_v$1.6 (HGNC: *KCNA6*) (NCBI: NM_002235) (SEQ ID NO: 26)
MRSEKSLTLAAPGEVRGPEGEQQDAGDFPEAGGGGGCCSSERLVINISGLRFETQLRTLSLFPDTLLGDPGRRVRFF
DPLRNEYFFDRNRPSFDAILYYYQSGGRLRRPVNVPLDIFLEEIRFYQLGDEALAAFREDEGCLPEGGEDEKPLPSQ
PFQRQVWLLFEYPESSGPARGIAIVSVLVILISIVIFCLETLPQFRVDGRGGNNGGVSRVSPVSRGSQEEEEDEDDS
YTFHHGITPGEMGTGGSSSLSTLGGSFFTDPFFLVETLCIVWFTFELLVRFSACPSKPAFFRNIMNIIDLVAIFPYF
ITLGTELVQQQEQQPASGGGGQNGQQAMSLAILRVIRLVRVFRIFKLSRHSKGLQILGKTLQASMRELGLLIFFLFI
GVILFSSAVYFAEADDDDSLFPSIPDAFWWAVVTMTTVGYGDMYPMTVGGKIVGSLCAIAGVLTIALPVPVIVSNFN
YFYHRETEQEEQGQYTHVTCGQPAPDLRATDNGLGKPDFPEANRERRPSYLPTPHRAYAEKRMLTEV

Figure 14U

**human K$_v$1.7 (HGNC: *KCNA7*) (NCBI: NM_031886) (SEQ ID NO: 27)**

MEPRCPPPCGCCERLVLNVAGLRFETRARTLGRFPDTLLGDPARRGRFYDDARREYFFDRHRPSFDAVLYYYQSGGR
LRRPAHVPLDVFLEEVAFYGLGAAALARLREDEGCPVPPERPLPRRAFARQLWLLFEFPESSQAARVLAVVSVLVIL
VSIVVFCLETLPDFRDDRDGTGLAAAAAGPFPAPLNGSSQMPGNPPRLPFNDPFFVVETLCICWFSFELLVRLLVC
PSKAIFFKNVMNLIDFVAILPYFVALGTELARQRGVGQQAMSLAILRVIRLVRVFRIFKLSRHSKGLQILGQTLRAS
MRELGLLIFFLFIGVVLFSSAVYFAEVDRVDSHFTSIPESFWWAVVTMTTVGYGDMAPVTVGGKIVGSLCAIAGVLT
ISLPVPVIVSNFSYFYHRETEGEEAGMFSHVDMQPCGPLEGKANGGLVDGEVPELPPPLWAPPGKHLVTEV

**human K$_v$1.8 (HGNC: *KCNA10*) (NCBI: NM_005549) (SEQ ID NO: 28)**

MDVCGWKEMEVALVNFDNSDEIQEEPGYATDFDSTSPKGRPGGSSFSNGKILISESTNHETAFSKLPGDYADPPGPE
PVVLNEGNQRVIINIAGLRFETQLRTLSQFPETLLGDREKRMQFFDSMRNEYFFDRNRPSFDGILYYYQSGGKIRRP
ANVPIDIFADEISFYELGSEAMDQFREDEGFIKDPETLLPTNDIHRQFWLLFEYPESSSAARAVAVVSVLVVVISIT
IFCLETLPEFREDRELKVVRDPNLNMSKTVLSQTMFTDPFFMVESTCIVWFTFELVLRFVVCPSKTDFFRNIMNIID
IISIIPYFATLITELVQETEPSAQQNMSLAILRIIRLVRVFRIFKLSRHSKGLQILGQTLKASMRELGLLIFFLFIG
VILFSSAVYFAEVDEPESHFSSIPDGFWWAVVTMTTVGYGDMCPTTPGGKIVGTLCAIAGVLTIALPVPVIVSNFNY
FYHRETENEEKQNIPGEIERILNSVGSRMGSTDSLNKTNGGCSTEKSRK

**human K$_v$2.1 (HGNC: *KCNB1*) (NCBI: NM_004975) (SEQ ID NO: 29)**

MPAGMTKHGSRSTSSLPPEPMEIVRSKACSRRVRLNVGGLAHEVLWRTLDRLPRTRLGKLRDCNTHDSLLEVCDDYS
LDDNEYFFDRHPGAFTSILNFYRTGRLHMMEEMCALSFSQELDYWGIDEIYLESCCQARYHQKKEQMNEELKREAET
LREREGEEFDNTCCAEKRKKLWDLLEKPNSSVAAKILAIISIMFIVLSTIALSLNTLPELQSLDEFGQSTDNPQLAH
VEAVCIAWFTMEYLLRFLSSPKKWKFFKGPLNAIDLLAILPYYVTIFLTESNKSVLQFQNVRRVVQIFRIMRILRIL
KLARHSTGLQSLGFTLRRSYNELGLLILFLAMGIMIFSSLVFFAEKDEDDTKFKSIPASFWWATITMTTVGYGDIYP
KTLLGKIVGGLCCIAGVLVIALPIPIIVNNFSEFYKEQKRQEKAIKRREALERAKRNGSIVSMNMKDAFARSIEMMD
IVVEKNGENMGKKDKVQDNHLSPNKWKWTKRTLSETSSSKSFETKEQGSPEKARSSSSPQHLNVQQLEDMYNKMAKT
QSQPILNTKESAAQSKPKEELEMESIPSPVAPLPTRTEGVIDMRSMSSIDSFISCATDFPEATRFSHSPLTSLPSKT
GGSTAPEVGWRGALGASGGRFVEANPSPDASQHSSFFIESPKSSMKTNNPLKLRALKVNFMEGDPSPLLPVLGMYHD
PLRNRGSAAAAVAGLECATLLDKAVLSPESSIYTTASAKTPPRSPEKHTAIAFNFEAGVHQYIDADTDDEGQLLYSV
DSSPPKSLPGSTSPKFSTGTRSEKNHFESSPLPTSPKFLRQNCIYSTEALTGKGPSGQEKCKLENHISPDVRVLPGG
GAHGSTRDQSI

Figure 14V human K_v2.2 (HGNC: *KCNB2*) (NCBI: NM_004770) (SEQ ID NO: 30)

MAEKAPPGLNRKTSRSTLSLPPEPVDIIRSKTCSRRVKINVGGLNHEVLWRTLDRLPRTRLGKLRDCNTHESLLEVC
DDYNLNENEYFFDRHPGAFTSILNFYRTGKLHMMEEMCALSFGQELDYWGIDEIYLESCCQARYHQKKEQMNEELRR
EAETMREREGEEFDNTCCPDKRKKLWDLLEKPNSSVAAKILAIVSILFIVLSTIALSLNTLPELQETDEFGQLNDNR
QLAHVEAVCIAWFTMEYLLRFLSSPNKWKFFKGPLNVIDLLAILPYYVTIFLTESNKSVLQFQNVRRVVQIFRIMRI
LRILKLARHSTGLQSLGFTLRRSYNELGLLILFLAMGIMIFSSLVFFAEKDEDATKFTSIPASFWWATITMTTVGYG
DIYPKTLLGKIVGGLCCIAGVLVIALPIPIIVNNFSEFYKEQKRQEKAIKRREALERAKRNGSIVSMNLKDAFARSM
ELIDVAVEKAGESANTKDSADDNHLSPSRWKWARKALSETSSNKSFENKYQEVSQKDSHEQLNNTSSSSPQHLSAQK
LEMLYNEITKTQPHSHPNPDCQEKPERPSAYEEEIEMEEVVCPQEQLAVAQTEVIVDMKSTSSIDSFTSCATDFTET
ERSPLPPPSASHLQMKFPTDLPGTEEHQRARGPPFLTLSREKGPAARDGTLEYAPVDITVNLDASGSQCGLHSPLQS
DNATDSPKSSLKGSNPLKSRSLKVNFKENRGSAPQTPPSTARPLPVTTADFSLTTPQHISTILLEETPSQGDRPLLG
TEVSAPCQGPSKGLSPRFPKQKLFPFSSRERRSFTEIDTGDDEDFLELPGAREEKQVDSSPNCFADKPSDGRDPLRE
EGSVGSSSPQDTGHNCRQDIYHAVSEVKKDSSQEGCKMENHLFAPEIHSNPGDTGYCPTRETSM human K_v3.1 (HGNC: *KCNC1*) (NCBI: NM_004976) (SEQ ID NO: 31)

MGQGDESERIVINVGGTRHQTYRSTLRTLPGTRLAWLAEPDAHSHFDYDPRADEFFFDRHPGVFAHILNYYRTGKLH
CPADVCGPLYEEELAFWGIDETDVEPCCWMTYRQHRDAEEALDSFGGAPLDNSADDADADGPGDSGDGEDELEMTKR
LALSDSPDGRPGGFWRRWQPRIWALFEDPYSSRYARYVAFASLFFILVSITTFCLETHERFNPIVNKTEIENVRNGT
QVRYYREAETEAFLTYIEGVCVVWFTFEFLMRVIFCPNKVEFIKNSLNIIDFVAILPFYLEVGLSGLSSKAAKDVLG
FLRVVRFVRILRIFKLTRHFVGLRVLGHTLRASTNEFLLLIIFLALGVLIFATMIYYAERIGAQPNDPSASEHTHFK
NIPIGFWWAVVTMTTLGYGDMYPQTWSGMLVGALCALAGVLTIAMPVPVIVNNFGMYYSLAMAKQKLPKKKKHIPR
PPQLGSPNYCKSVVNSPHHSTQSDTCPLAQEEILEINRAGRKPLPGMSI human K_v3.2 (HGNC: *KCNC2*) (NCBI: NM_139136) (SEQ ID NO: 32)

MGKIENNERVILNVGGTRHETYRSTLKTLPGTRLALLASSEPPGDCLTTAGDKLQPSPPPLSPPPRAPFLSPGPGGC
FEGGAGNCSSRGGRASDHPGGGREFFFDRHPGVFAYVLNYYRTGKLHCPADVCGPLFEEELAFWGIDETDVEPCCWM
TYRQHRDAEEALDIFETPDLIGGDPGDDEDLAAKRLGIEDAAGLGGPDGKSGRWRRLQPRMWALFEDPYSSRAARFI
AFASLFFILVSITTFCLETHEAFNIVKNKTEPVINGTSVVLQYEIETDPALTYVEGVCVVWFTFEFLVRIVFSPNKL
EFIKNLLNIIDFVAILPFYLEVGLSGLSSKAAKDVLGFLRVVRFVRILRIFKLTRHFVGLRVLGHTLRASTNEFLLL
IIFLALGVLIFATMIYYAERVGAQPNDPSASEHTQFKNIPIGFWWAVVTMTTLGYGDMYPQTWSGMLVGALCALAGV
LTIAMPVPVIVNNFGMYYSLAMAKQKLPRKRKKHIPPAPQASSPTFCKTELNMACNSTQSDTCLGKDNRLLEHNRSV
LSGDDSTGSEPPLSPPERLPIRRSSTRDKNRRGETCFLLTTGDYTCASDGGIRKDNCKEVVITGYTQAEARSLT

Figure 14W

**human K$_v$3.3 (HGNC: *KCNC3*) (NCBI: NM_004977) (SEQ ID NO: 33)**

MLSSVCVSSFRGRQGASKQQPAPPPQPPESPPPPPLPPQQQQPAQPGPAASPAGPPAPRGPGDRRAEPCPGLPAAAM
GRHGGGGGDSGKIVINVGGVRHETYRSTLRTLPGTRLAGLTEPEAAARFDYDPGADEFFFDRHPGVFAYVLNYYRTG
KLHCPADVCGPLFEEELGFWGIDETDVEACCWMTYRQHRDAEEALDSFEAPDPAGAANAANAAGAHDGGLDDEAGAG
GGGLDGAGGELKRLCFQDAGGGAGGPPGGAGGAGGTWWRRWQPRVWALFEDPYSSRAARYVAFASLFFILISITTFC
LETHEGFIHISNKTVTQASPIPGAPPENITNVEVETEPFLTYVEGVCVVWFTFEFLMRITFCPDKVEFLKSSLNIID
CVAILPFYLEVGLSGLSSKAAKDVLGFLRVVRFVRILRIFKLTRHFVGLRVLGHTLRASTNEFLLLIIFLALGVLIF
ATMIYYAERIGADPDDILGSNHTYFKNIPIGFWWAVVTMTTLGYGDMYPKTWSGMLVGALCALAGVLTIAMPVPVIV
NNFGMYYSLAMAKQKLPKKKNKHIPRPPQPGSPNYCKPDPPPPPPHPHHGSGGISPPPPITPPSMGVTVAGAYPAG
PHTHPGLLRGGAGGLGIMGLPPLPAPGEPCPLAQEEVIEINRADPRPNGDPAAAALAHEDCPAIDQPAMSPEDKSPI
TPGSRGRYSRDRACFLLTDYAPSPDGSIRKATGAPPLPPQDWRKPGPPSFLPDLNANAAAWISP

**human K$_v$3.4 (HGNC: *KCNC4*) (NCBI: NM_004978) (SEQ ID NO: 34)**

MISSVCVSSYRGRKSGNKPPSKTCLKEEMAKGEASEKIIINVGGTRHETYRSTLRTLPGTRLAWLADPDGGGRPETD
GGGVGSSGSSGGGGCEFFFDRHPGVFAYVLNYYRTGKLHCPADVCGPLFEEELTFWGIDETDVEPCCWMTYRQHRDA
EEALDIFESPDGGGSGAPSDEAGDDERELALQRLGPHEGGAGHGAGSGGCRGWQPRMWALFEDPYSSRAARVVAFA
SLFFILVSITTFCLETHEAFNIDRNVTEILRVGNITSVHFRREVETEPILTYIEGVCVLWFTLEFLVRIVCCPDTLD
FVKNLLNIIDFVAILPFYLEVGLSGLSSKAARDVLGFLRVVRFVRILRIFKLTRHFVGLRVLGHTLRASTNEFLLLI
IFLALGVLIFATMIYYAERIGARPSDPRGNDHTDFKNIPIGFWWAVVTMTTLGYGDMYPKTWSGMLVGALCALAGVL
TIAMPVPVIVNNFGMYYSLAMAKQKLPKKRKKHVPRPAQLESPMYCKSEETSPRDSTCSDTSPPAREEGMIERKRAD
SKQNGDANAVLSDEEGAGLTQPLASSPTPEERRALRRSTTRDRNKKAAACFLLSTGDYACADGSVRKGTFVLRDLPL
QHSPEAACPPTAGTLFLPH

**human K$_v$4.1 (HGNC: *KCND1*) (NCBI: NM_004979) (SEQ ID NO: 35)**

MAAGLATWLPFARAAAVGWLPLAQQPLPPAPGVKASRGDEVLVVNVSGRRFETWKNTLDRYPDTLLGSSEKEFFYDA
DSGEYFFDRDPDMFRHVLNFYRTGRLHCPRQECIQAFDEELAFYGLVPELVGDCCLEEYRDRKKENAERLAEDEEAE
QAGDGPALPAGSSLRQRLWRAFENPHTSTAALVFYVTGFFIAVSVIANVVETIPCRGSARRSSREQPCGERFPQAF
FCMDTACVLIFTGEYLLRLFAAPSRCRFLRSVMSLIDVVAILPYYIGLLVPKNDDVSGAFVTLRVFRVFRIFKFSRH
SQGLRILGYTLKSCASELGFLLFSLTMAIIIFATVMFYAEKGTNKTNFTSIPAAFWYTIVTMTTLGYGDMVPSTIAG
KIFGSICSLSGVLVIALPVPVIVSNFSRIYHQNQRADKRRAQQKVRLARIRLAKSGTTNAFLQYKQNGGLEDSGSGE
EQALCVRNRSAFEQQHHHLLHCLEKTTCHEFTDELTFSEALGAVSPGGRTSRSTSVSSQPVGPGSLLSSCCPRRAKR
RAIRLANSTASVSRGSMQELDMLAGLRRSHAPQSRSSLNAKPHDSLDLNCDSRDFVAAIISIPTPPANTPDESQPSS
PGGGGRAGSTLRNSSLGTPCLFPETVKISSL

Figure 14X human K,4.2 (HGNC: *KCND2*) (NCBI: NM_012281) (SEQ ID NO: 36)
MAAGVAAWLPFARAAAIGWMPVASGPMPAPPRQERKRTQDALIVLNVSGTRFQTWQDTLERYPDTLLGSSERDFFYH
PETQQYFFDRDPDIFRHILNFYRTGKLHYPRHECISAYDEELAFFGLIPEIIGDCCYEEYKDRRRENAERLQDDADT
DTAGESALPTMTARQRVWRAFENPHTSTMALVFYYVTGFFIAVSVIANVVETVPCGSSPGHIKELPCGERYAVAFFC
LDTACVMIFTVEYLLRLAAAPSRYRFVRSVMSIIDVVAILPYYIGLVMTDNEDVSGAFVTLRVFRVFRIFKFSRHSQ
GLRILGYTLKSCASELGFLLFSLTMAIIIFATVMFYAEKGSSASKFTSIPAAFWYTIVTMTTLGYGDMVPKTIAGKI
FGSICSLSGVLVIALPVPVIVSNFSRIYHQNQRADKRRAQKKARLARIRAAKSGSANAYMQSKRNGLLSNQLQSSED
EQAFVSKSGSSFETQHHHLLHCLEKTTNHEFVDEQVFEESCMEVATVNRPSSHSPSLSSQQGVTSTCCSRRHKKTFR
IPNANVSGSHQGSIQELSTIQIRCVERTPLSNSRSSLNAKMEECVKLNCEQPYVTTAIISIPTPPVTTPEGDDRPES
PEYSGGNIVRVSAL human K,4.3 (HGNC: *KCND3*) (NCBI: NM_004980) (SEQ ID NO: 37)
MAAGVAAWLPFARAAAIGWMPVANCPMPLAPADKNKRQDELIVLNVSGRRFQTWRTTLERYPDTLLGSTEKEFFFNE
DTKEYFFDRDPEVFRCVLNFYRTGKLHYPRYECISAYDDELAFYGILPEIIGDCCYEEYKDRKRENAERLMDDNDSE
NNQESMPSLSFRQTMWRAFENPHTSTLALVFYYVTGFFIAVSVITNVVETVPCGTVPGSKELPCGERYSVAFFCLDT
ACVMIFTVEYLLRLFAAPSRYRFIRSVMSIIDVVAIMPYYIGLVMTNNEDVSGAFVTLRVFRVFRIFKFSRHSQGLR
ILGYTLKSCASELGFLLFSLTMAIIIFATVMFYAEKGSSASKFTSIPASFWYTIVTMTTLGYGDMVPKTIAGKIFGS
ICSLSGVLVIALPVPVIVSNFSRIYHQNQRADKRRAQKKARLARIRVAKTGSSNAYLHSKRNGLLNEALELTGTPEE
EHMGKTTSLIESQHHHLLHCLEKTTGLSYLVDDPLLSVRTSTIKNHEFIDEQMFEQNCMESSMQNYPSTRSPSLSSH
PGLTTTCCSRRSKKTTHLPNSNLPATRLRSMQELSTIHIQGSEQPSLTTSRSSLNLKADDGLRPNCKTSQITTAIIS
IPTPPALTPEGESRPPPASPGPNTNIPSIASNVVKVSAL human K,5.1 (HGNC: *KCNF1*) (NCBI: NM_002236) (SEQ ID NO: 38)
MDGSGERSLPEPGSQSSAASDDIEIVVNGGVRQVLYGDLLSQYPETRLAELINCLAGGYDTIFSLCDDYDPGKREF
YFDRDPDAFKCVIEVYYFGEVHMKKGICPICFKNEMDFWKVDLKFLDDCCKSHLSEKREELEEIARRVQLILDDLGV
DAAEGRWRRCQKCVWKFLEKPESSCPARVVAVLSFLLILVSSVVMCMGTIPELQVLDAEGNRVEHPTLENVETACIG
WFTLEYLLRLFSSPNKLHFALSFMNIVDVLAILPFYVSLTLTHLGARMMELTNVQQAVQALRIMRIARIFKLARHSS
GLQTLTYALKRSFKELGLLLMYLAVGIFVFSALGYTMEQSHPETLFKSIPQSFWWAIITMTTVGYGDIYPKTTLGKL
NAAISFLCGVIAIALPIHPIINNFVRYYNKQRVLETAAKHELELMELNSSSGGEGKTGGSRSDLDNLPPEPAGKEAP
SCSSRLKLSHSDTFIPLLTEEKHHRTRLQSCK

Figure 14Y human K$_v$6.1 (HGNC: *KCNG1*) (NCBI: NM_002237) (SEQ ID NO: 39)

MTLLPGDNSDYDYSALSCTSDASFHPAFLPQRQAIKGAFYRRAQRLRPQDEPRQGCQPEDRRRRIIINVGGIKYSLP
WTTLDEFPLTRLGQLKACTNFDDILNVCDDYDVTCNEFFFDRNPGAFGTILTFLRAGKLRLLREMCALSFQEELLYW
GIAEDHLDGCCKRRYLQKIEEFAEMVEREEEDDALDSEGRDSEGPAEGEGRLGRCMRRLRDMVERPHSGLPGKVFAC
LSVLFVTVTAVNLSVSTLPSLREEEEQGHCSQMCHNVFIVESVCVGWFSLEFLLRLIQAPSKFAFLRSPLTLIDLVA
ILPYYITLLVDGAAAGRRKPGAGNSYLDKVGLVLRVLRALRILYVMRLARHSLGLQTLGLTARRCTREFGLLLLFLC
VAIALFAPLLYVIENEMADSPEFTSIPACYWWAVITMTTVGYGDMVPRSTPGQVVALSSILSGILLMAFPVTSIFHT
FSRSYLELKQEQERVMFRRAQFLIKTKSQLSVSQDSDILFGSASSDTRDNN human K$_v$6.2 (HGNC: *KCNG2*) (NCBI: NM_012283) (SEQ ID NO: 40)

MEPWPCSPGGGGGTRARHVIINVGGCRVRLAWAALARCPLARLEPLRACRGHDDLLRVCDDYDVSRDEFFFDRSPCA
FRAIVALLRAGKLRLLRGPCALAFRDELAYWGIDEARLERCCLRRLRRREEEAAEARAGPTERGAQGSPARALGPRG
RLQRGRRRLRDVVDNPHSGLAGKLFACVSVSFVAVTAVGLCLSTMPDIRAEEERGECSPKCRSLFVLETVCVAWFSF
EFLLRSLQAESKCAFLRAPLNIIDILALLPFYVSLLLGLAAGPGGTKLLERAGLVLRLLRALRVLYVMRLARHSLGL
RSLGLTMRRCAREFGLLLLFLCVAMALFAPLVHLAERELGARRDFSSVPASYWWAVISMTTVGYGDMVPRSLPGQVV
ALSSILSGILLMAFPVTSIFHTFSRSYSELKEQQQRAASPEPALQEDSTHSATATEDSSQGPDSAGLADDSADALWV
RAGR human K$_v$6.3 (HGNC: *KCNG3*) (NCBI: NM_133329) (SEQ ID NO: 41)

MTFGRSGAASVVLNVGGARYSLSRELLKDFPLRRVSRLHGCRSERDVLEVCDDYDRERNEYFFDRHSEAFGFILLYV
RGHGKLRFAPRMCELSFYNEMIYWGLEGAHLEYCCQRRLDDRMSDTYTFYSADEPGVLGRDEARPGGAEAAPSRRWL
ERMRRTFEEPTSSLAAQILASVSVVFVIVSMVVLCASTLPDWRNAAADNRSLDDRSRYSAGPGREPSGIIEAICIGW
FTAECIVRFIVSKNKCEFVKRPLNIIDLLAITPYYISVLMTVFTGENSQLQRAGVTLRVLRMMRIFWVIKLARHFIG
LQTLGLTLKRCYREMVMLLVFICVAMAIFSALSQLLEHGLDLETSNKDFTSIPAACWWVIISMTTVGYGDMYPITVP
GRILGGVCVVSGIVLLALPITFIYHSFVQCYHELKFRSARYSRSLSTEFLN human K$_v$6.4 (HGNC: *KCNG4*) (NCBI: NM_172347) (SEQ ID NO: 42)

MPMPSRDGGLHPRHHHYGSHSPWSQLLSSPMETPSIKGLYYRRVRKVGALDASPVDLKKEILINVGGRRYLLPWSTL
DRFPLSRLSKLRLCRSYEEIVQLCDDYDEDSQEFFFDRSPSAFGVIVSFLAAGKLVLLQEMCALSFQEELAYWGIEE
AHLERCCLRKLLRKLEELEELAKLHREDVLRQQRETRRPASHSSRWGLCMNRLREMVENPQSGLPGKVFACLSILFV
ATTAVSLCVSTMPDLRAEEDQGECSRKCYYIFIVETICVAWFSLEFCLRFVQAQDKCQFFQGFPLNIIDILAISPYYV
SLAVSEEPPEDGERPSGSSYLEKVGLVLRVLRALRILYVMRLARHSLGLQTLGLTVRRCTREFGLLLLFLAVAITLF
SPLVYVAEKESGRVLEFTSIPASYWWAIISMTTVGYGDMVPRSVPGQMVALSSILSGILIMAFPATSIFHTFSHSYL
ELKKEQEQLQARLRHLQNTGPASECELLDPHVASEHELMNDVNDLILEGPALPIMHM

Figure 14Z

**human K$_v$7.1 (HGNC: *KCNQ1*) (NCBI: NM_000218) (SEQ ID NO: 43)**

MAAASSPPRAERKRWGWGRLPGARRGSAGLAKKCPFSLELAEGGPAGGALYAPIAPGAPGPAPPASPAAPAAPPVAS
DLGPRPPVSLDPRVSIYSTRRPVLARTHVQGRVYNFLERPTGWKCFVYHFAVFLIVLVCLIFSVLSTIEQYAALATG
TLFWMEIVLVVFFGTEYVVRLWSAGCRSKYVGLWGRLRFARKPISIIDLIVVVASMVVLCVGSKGQVFATSAIRGIR
FLQILRMLHVDRQGGTWRLLGSVVFIHRQELITTLYIGFLGLIFSSYFVYLAEKDAVNESGRVEFGSYADALWWGVV
TVTTIGYGDKVPQTWVGKTIASCFSVFAISFFALPAGILGSGFALKVQQKQRQKHFNRQIPAAASLIQTAWRCYAAE
NPDSSTWKIYIRKAPRSHTLLSPSPKPKKSVVVKKKKFKLDKDNGVTPGEKMLTVPHITCDPPEERRLDHFSVDGYD
SSVRKSPTLLEVSMPHFMRTNSFAEDLDLEGETLLTPITHISQLREHHRATIKVIRRMQYFVAKKKFQQARKPYDVR
DVIEQYSQGHLNLMVRIKELQRRLDQSIGKPSLFISVSEKSKDRGSNTIGARLNRVEDKVTQLDQRLALITDMLHQL
LSLHGGSTPGSGGPPREGGAHITQPCGSGGSVDPELFLPSNTLPTYEQLTVPRRGPDEGS

**human K$_v$7.2 (HGNC: *KCNQ2*) (NCBI: NM_172107) (SEQ ID NO: 44)**

MVQKSRNGGVYPGPSGEKKLKVGFVGLDPGAPDSTRDGALLIAGSEAPKRGSILSKPRAGGAGAGKPPKRNAFYRKL
QNFLYNVLERPRGWAFIYHAYVFLLVFSCLVLSVFSTIKEYEKSSEGALYILEIVTIVVFGVEYFVRIWAAGCCCRY
RGWRGRLKFARKPFCVIDIMVLIASIAVLAAGSQGNVFATSALRSLRFLQILRMIRMDRRGGTWKLLGSVVYAHSKE
LVTAWYIGFLCLILASFLVYLAEKGENDHFDTYADALWWGLITLTTIGYGDKYPQTWNGRLLAATFTLIGVSFFALP
AGILGSGFALKVQEQHRQKHFEKRRNPAAGLIQSAWRFYATNLSRTDLHSTWQYYERTVTVPMYSSQTQTYGASRLI
PPLNQLELLRNLKSKSGLAFRKDPPPEPSPSKGSPCRGPLCGCCPGRSSQKVSLKDRVFSSPRGVAAKGKGSPQAQT
VRRSPSADQSLEDSPSKVPKSWSFGDRSRARQAFRIKGAASRQNSEEASLPGEDIVDDKSCPCEFVTEDLTPGLKVS
IRAVCVMRFLVSKRKFKESLRPYDVMDVIEQYSAGHLDMLSRIKSLQSRVDQIVGRGPAITDKDRTKGPAEAELPED
PSMMGRLGKVEKQVLSMEKKLDFLVNIYMQRMGIPPTETEAYFGAKEPEPAPPYHSPEDSREHVDRHGCIVKIVRSS
SSTGQKNFSAPPAAPPVQCPPSTSWQPQSHPRQGHGTSPVGDHGSLVRIPPPPAHERSLSAYGGGNRASMEFLRQED
TPGCRPPEGNLRDSDTSISIPSVDHEELERSFSGFSISQSKENLDALNSCYAAVAPCAKVRPYIAEGESDTDSDLCT
PCGPPPRSATGEGPFGDVGWAGPRK

**human K$_v$7.3 (HGNC: *KCNQ3*) (NCBI: NM_004519) (SEQ ID NO: 45)**

MGLKARRAAGAAGGGGDGGGGGGGAANPAGGDAAAAGDEERKVGLAPGDVEQVTLALGAGADKDGTLLEGGGRDEG
QRRTPQGIGLLAKTPLSRPVKRNNAKYRRIQTLIYDALERPRGWALLYHALVFLIVLGCLILAVLTTFKEYETVSGD
WLLLLETFAIFIFGAEFALRIWAAGCCCRYKGWRGRLKFARKPLCMLDIFVLIASVPVVAVGNQGNVLATSLRSLRF
LQILRMLRMDRRGGTWKLLGSAICAHSKELITAWYIGFLTLILSSFLVYLVEKDVPEVDAQGEEMKEEFETYADALW
WGLITLATIGYGDKTPKTWEGRLIAATFSLIGVSFFALPAGILGSGLALKVQEQHRQKHFEKRRKPAAELIQAAWRY
YATNPNRIDLVATWRFYESVVSFPFFRKEQLEAASSQKLGLLDRVRLSNPRGSNTKGKLFTPLNVDAIEESPSKEPK
PVGLNNKERFRTAFRMKAYAFWQSSEDAGTGDPMAEDRGYGNDFPIEDMIPTLKAAIRAVRILQFRLYKKKFKETLR
PYDVKDVIEQYSAGHLDMLSRIKYLQTRIDMIFTPGPPSTPKHKKSQKGSAFTFPSQQSPRNEPYVARPSTSEIEDQ
SMMGKFVKVERQVQDMGKKLDFLVDMHMQHMERLQVQVTEYYPTKGTSSPAEAEKKEDNRYSDLKTIICNYSETGPP
EPPYSFHQVTIDKVSPYGFFAHDPVNLPRGGPSSGKVQATPPSSATTYVERPTVLPILTLLDSRVSCHSQADLQGPY
SDRISPRQRRSITRDSDTPLSLMSVNHEELERSPSGFSISQDRDDYVFGPNGGSSWMREKRYLAEGETDTDTDPFTP
SGSMPLSSTGDGISDSVWTPSNKPI

Figure 14AA

**human K$_v$7.4 (HGNC: *KCNQ4*) (NCBI: NM_004700) (SEQ ID NO: 46)**

MAEAPPRRLGLGPPPGDAPRAELVALTAVQSEQGEAGGGGSPRRLGLLGSPLPPGAPLPGPGSGSGSACGQRSSAAH
KRYRRLQNWVYNVLERPRGWAFVYHVFIFLLVFSCLVLSVLSTIQEHQELANECLLILEFVMIVVFGLEYIVRVWSA
GCCCRYRGWQGRFRFARKPFCVIDFIVFVASVAVIAAGTQGNIFATSALRSMRFLQILRMVRMDRRGGTWKLLGSVV
YAHSKELITAWYIGFLVLIFASFLVYLAEKDANSDFSSYADSLWWGTITLTTIGYGDKTPHTWLGRVLAAGFALLGI
SFFALPAGILGSGFALKVQEQHRQKHFEKRRMPAANLIQAAWRLYSTDMSRAYLTATWYYYDSILPSFRELALLFEH
VQRAPNGGLRPLEVRRAPVPDGAPSRYPPVATCHRPGSTSFCPGESSRMGIKDRIRMGSSQRRTGPSKQHLAPPTMP
TSPSSEQVGEATSPTKVQKSWSFNDRTRFRASLRLKPRTSAEDAPSEEVAEEKSYQCELTVDDIMPAVKTVIRSIRI
LKFLVAKRKFKETLRPYDVKDVIEQYSAGHLDMLGRIKSLQTRVDQIVGRGPGDRKAREKGDKGPSDAEVVDEISMM
GRVVKVEKQVQSIEHKLDLLLGFYSRCLRSGTSASLGAVQVPLFDPDITSDYHSPVDHEDISVSAQTLSISRSVSTN
MD

**human K$_v$7.5 (HGNC: *KCNQ*) (NCBI: NM_019842) (SEQ ID NO: 47)**

MPRHHAGGEEGGAAGLWVKSGAAAAAGGGRLGSGMKDVESGRGRVLLNSAAARGDGLLLLGTRAATLGGGGGGLRE
SRRGKQGARMSLLGKPLSYTSSQSCRRNVKYRRVQNYLYNVLERPRGWAFIYHAFVFLLVFGCLILSVFSTIPEHTK
LASSCLLILEFVMIVVFGLEFIIRIWSAGCCCRYRGWQGRLRFARKPFCVIDTIVLIASIAVVSAKTQGNIFATSAL
RSLRFLQILRMVRMDRRGGTWKLLGSVVYAHSKELITAWYIGFLVLIFSSFLVYLVEKDANKEFSTYADALWWGTIT
LTTIGYGDKTPLTWLGRLLSAGFALLGISFFALPAGILGSGFALKVQEQHRQKHFEKRRNPAANLIQCVWRSYAADE
KSVSIATWKPHLKALHTCSPTKKEQGEASSSQKLSFKERVRMASPRGQSIKSRQASVGDRRSPSTDITAEGSPTKVQ
KSWSFNDRTRFRPSLRLKSSQPKPVIDADTALGTDDVYDEKGCQCDVSVEDLTPPLKTVIRAIRIMKFHVAKRKFKE
TLRPYDVKDVIEQYSAGHLDMLCRIKSLQTRVDQILGKGQITSDKKSREKITAEHETTDDLSMLGRVVKVEKQVQSI
ESKLDCLLDIYQQVLRKGSASALALASFQIPPFECEQTSDYQSPVDSKDLSGSAQNSGCLSRSTSANISRGLQFILT
PNEFSAQTFYALSPTMHSQATQVPISQSDGSAVAATNTIANQINTAPKPAAPTTLQIPPPLPAIKHLPRPETLHPNP
AGLQESISDVTTCLVASKENVQVAQSNLTKDRSMRKSFDMGGETLLSVCPMVPKDLGKSLSVQNLIRSTEELNIQLS
GSESSGSRGSQDFYPKWRESKLFITDEEVGPEETETDTFDAAPQPAREAAFASDSLRTGRSRSSQSICKAGESTDAL
SLPHVKLK

**human K$_v$8.1 (HGNC: *KCNV1*) (NCBI: NM_014379) (SEQ ID NO: 48)**

MPSSGRALLDSPLDSGSLTSLDSSVFCSEGEGEPLALGDCFTVNVGGSRFVLSQQALSCFPHTRLGKLAVVVASYRR
PGALAAVPSPLELCDDANPVDNEYFFDRSSQAFRYVLHYYRTGRLHVMEQLCALSFLQEIQYWGIDELSIDSCCRDR
YFRRKELSETLDFKKDTEDQESQHESEQDFSQGPCPTVRQKLWNILEKPGSSTAARIFGVISIIFVVVSIINMALMS
AELSWLDLQLLEILEYVCISWFTGEFVLRFLCVRDRCRFLRKVPNIIDLLAILPFYITLVESLGSQTTQELENVG
RIVQVLRLLRALRMLKLGRHSTGLRSLGMTITQCYEEVGLLLLFLSVGISIFSTVEYFAEQSIPDTTFTSVPCAWWW
ATTSMTTVGYGDIRPDTTTGKIVAFMCILSGILVLALPIAIINDRFSACYFTLKLKEAAVRQREALKKLTKNIATDS
YISVNLRDVYARSIMEMLRLKGRERASTRSSGGDDFWF

Figure 14AB human K$_v$8.2 (HGNC: *KCNV2*) (NCBI: NM_133497) (SEQ ID NO: 49)

MLKQSERRRSWSYRPWNTTENEGSQHRRSICSLGARSGSQASIHGWTEGNYNYYIEEDEDGEEEDQWKDDLAEEDQQ
AGEVTTAKPEGPSDPPALLSTLNVNVGGHSYQLDYCELAGFPKTRLGRLATSTSRSRQLSLCDDYEEQTDEYFFDRD
PAVFQLVYNFYLSGVLLVLDGLCPRRFLEELGYWGVRLKYTPRCCRICFEERRDELSERLKIQHELRAQAQVEEAEE
LFRDMRFYGPQRRRLWNLMEKPFSSVAAKAIGVASSTFVLVSVVALALNTVEEMQQHSGQGEGGPDLRPILEHVEML
CMGFFTLEYLLRLASTPDLRRFARSALNLVDLVAILPLYLQLLLECFTGEGHQRGQTVGSVGKVGQVLRVMRLMRIF
RILKLARHSTGLRAFGFTLRQCYQQVGCLLLFIAMGIFTFSAAVYSVEHDVPSTNFTTIPHSWWWAAVSISTVGYGD
MYPETHLGRFFAFLCIAFGIILNGMPISILYNKFSDYYSKLKAYEYTTIRRERGEVNFMQRARKKIAECLLGSNPQL
TPRQEN human K$_v$9.1 (HGNC: *KCNS1*) (NCBI: NM_002251) (SEQ ID NO: 50)

MLMLLVRGTHYENLRSKVVLPTPLGGRSTETFVSEFPGPDTGIRWRRSDEALRVNVGGVRRQLSARALARFPGTRLG
RLQAAASEEQARRLCDDYDEAAREFYFDRHPGFFLSLLHFYRTGHLHVLDELCVFAFGQEADYWGLGENALAACCRA
RYLERRLTQPHAWDEDSDTPSSVDPCPDEISDVQRELARYGAARCGRLRRRLWLTMENPGYSLPSKLFSCVSISVVL
ASIAAMCIHSLPEYQAREAAAAVAAVAAGRSPEGVRDDPVLRRLEYFCIAWFSFEVSSRLLLAPSTRNFFCHPLNLI
DIVSVLPFYLTLLAGVALGDQGGKEFGHLGKVVQVFRLMRIFRVLKLARHSTGLRSLGATLKHSYREVGILLLYLAV
GVSVFSGVAYTAEKEEDVGFNTIPACWWWGTVSMTTVGYGDVVPVTVAGKLAASGCILGGILVVALPITIIFNKFSH
FYRRQKALEAAVRNSNHQEFEDLLSSIDGVSEASLETSRETSQEGQSADLESQAPSEPPHPQMY human K$_v$9.2 (HGNC: *KCNS2*) (NCBI: NM_020697) (SEQ ID NO: 51)

MTGQSLWDVSEANVEDGEIRINVGGFKRRLRSHTLLRFPETRLGRLLLCHSREAILELCDDYDDVQREFYFDRNPEL
FPYVLHFYHTGKLHVMAELCVFSFSQEIEYWGINEFFIDSCCSYSHGRKVEPEQEKWDEQSDQESTTSSFDEILAF
YNDASKFDGQPLGNFRRQLWLALDNPGYSVLSRVFSILSILVVMGSIITMCLNSLPDFQIPDSQGNPGEDPRFEIVE
HFGIAWFTFELVARFAVAPDFLKFFKNALNLIDLMSIVPFYITLVVNLVVESTPTLANLGRVAQVLRLMRIFRILKL
ARHSTGLRSLGATLKYSYKEVGLLLLYLSVGISFSVVAYTIEKEENEGLATIPACWWWATVSMTTVGYGDVVPGTT
AGKLTASACILAGILVVVLPITLIFNKFSHFYRRQKQLESAMRSCDFGDGMKEVPSVNLRDYYAHKVKSLMASLTNM
SRSSPSELSLNDSLR human K$_v$9.3 (HGNC: *KCNS3*) (NCBI: NM_023966) (SEQ ID NO: 52)

MTRQSLWDLSETDVEDGEIRINVGGFKRRLRSHTLLRFPETRLGRLLLCHSREAILELCDDYDDVQREFYFDRNPEL
FPYVLHFYHTGKLHVMAELCVFSFSQEIEYWGINEFFIDSCCSYSHGRKVEPEQEKWDEQSDQESTTSSFDEILAF
YNDASKFDGQPLGNFRRQLWLALDNPGYSVLSRVFSVLSILVVLGSIITMCLNSLPDFQIPDSQGNPGEDPRFEIVE
HFGIAWFTFELVARFAVAPDFLKFFKNALNLIDLMSIVPFYITLVVNLVVESSPTLANLGRVAQVLRLMRIFRILKL
ARHSTGLRSLGATLKYSYKEVGLLLLYLSVGISFSVVAYTIEKEENEGLATIPACWWWATVSMTTVGYGDVVPGTT
AGKLTASACILAGILVVVLPITLIFNKFSHFYRRQKQLESAMRSCDFGDGMKEVPSVNLRDYYAHKVKSLMASLTNM
SRSSPSELSLDDSLH

Figure 14AC human K,10.1 (HGNC: *KCNH1*) (NCBI: NM_172362) (SEQ ID NO: 53)
MTMAGGRRGLVAPQNTFLENIVRRSNDTNFVLGNAQIVDWPIVYSNDGFCKLSGYHRAEVMQKSSTCSFMYGELTDK
DTIEKVRQTFENYEMNSFEILMYKKNRTPVWFFVKIAPIRNEQDKVVLFLCTFSDITAFKQPIEDDSCKGWGKFARL
TRALTSSRGVLQQLAPSVQKGENVHKHSRLAEVLQLGSDILPQYKQEAPKTPPHIILHYCVFKTTWDWIILILTFYT
AILVPYNVSFKTRQNNVAWLVVDSIVDVIFLVDIVLNFHTTFVGPAGEVISDFKLIRMNYLKTWFVIDLLSCLPYDV
INAFENVDEVSAFMGDPGKIGFADQIPPPLEGRESQGISSLFSSLKVVRLLRLGRVARKLDHYIEYGAAVLVLLVCV
FGLAAHWMACIWYSIGDYEIFDEDTKTIRNNSWLYQLAMDIGTPYQFNGSGSGKWEGGPSKNSVYISSLYFTMTSLT
SVGFGNIAPSTDIEKIFAVAIMMIGSLLYATIFGNVTTIFQQMYANTNRYHEMLNSVRDFLKLYQVPKGLSERVMDY
IVSTWSMSRGIDTEKVLQICPKDMRADICVHLNRKVFKEHPAFRLASDGCLRALAMEFQTVHCAPGDLIYHAGESVD
SLCFVVSGSLEVIQDDEVVAILGKGDVFGDVFWKEATLAQSCANVRALTYCDLHVIKRDALQKVLEFYTAFSHSFSR
NLILTYNLRKRIVFRKISDVKREEEEPMKRKNEAPLILPPDHPVRRLFQRFRQQKEARLAAERGGRDLDDLDVEKGN
VLTEHASANHSLVKASVVTVRESPATPVSFQAASTSGVPDHAKLQAPGSECLGPKGGGGDCAKRKSWARFKDACGKS
EDWNKVSKAESMETLPERTKASGEATLKKTDSCDSGITKSDLRLDNVGEARSPQDRSPILAEVKHSFYPIPEQTLQA
TVLEVRHELKEDIKALNAKMTNIEKQLSEILRILTSRRSSQSPQELFEISRPQSPESERDIFGAS human K,10.2 (HGNC: *KCNH5*) (NCBI: NM_139318) (SEQ ID NO: 54)
MPGGKRGLVAPQNTFLENIVRRSSESSFLLGNAQIVDWPVVYSNDGFCKLSGYHRADVMQKSSTCSFMYGELTDKKT
IEKVRQTFDNYESNCFEVLLYKKNRTPVWFYMQIAPIRNEHEKVVLFLCTFKDITLFKQPIEDDSTKGWTKFARLTR
ALTNSRSVLQQLTPMNKTEVVHKHSRLAEVLQLGSDILPQYKQEAPKTPPHIILHYCAFKTTWDWVILILTFYTAIM
VPYNVSFKTKQNNIAWLVLDSVVDVIFLVDIVLNFHTTFVGPGGEVISDFKLIRMNYLKTWFVIDLLSCLPYDIINA
FENVDEGISSLFSSLKVVRLLRLGRVARKLDHYLEYGAAVLVLLVCVFGLVAHWLACIWYSIGDYEVIDEVTNTIQI
DSWLYQLALSIGTFYRYNTSAGIWEGGPSKDSLYVSSLYFTMTSLTTIGFGNIAPTTDVEKMFSVAMMMVGSLLYAT
IFGNVTTIFQQMYANTNRYHEMLNNVRDFLKLYQVPKGLSERVMDYIVSTWSMSKGIDTEKVLSICPKDMRADICVH
LNRKVFNEHPAFRLASDGCLRALAVEFQTIHCAPGDLIYHAGESVDALCFVVSGSLEVIQDDEVVAILGKGDVFGDI
FWKETTLAHACANVRALTYCDLHIIKREALLKVLDFYTAFANSFSRNLTLTCNLRKRIIFRKISDVKKEEEERLRQK
NEVTLSIPVDHPVRKLFQKFKQQKELRNQGSTQGDPERNQLQVESRSLQNGASITGTSVVTVSQITPIQTSLAYVKT
SESLKQNNRDAMELKPNGGADQKCLKVNSPIRMKNGNGKGWLRLKNNMGAHEEKKEDWNNVTKAESMGLLSEDPKSS
DSENSVTKNPLRKTDSCDSGITKSDLRLDKAGEARSPLEHSPIQADAKHPFYPIPEQALQTTLQEVKHELKEDIQLL
SCRMTALEKQVAEILKILSEKSVPQASSPKSQMPLQVPPQIPCQDIFSVSRPESPESDKDEIHF

Figure 14AD human K,11.1 (HGNC: *KCNH2*) (NCBI: NM_000238) (SEQ ID NO: 55)
MPVRRGHVAPQNTFLDTIIRKFEGQSRKFIIANARVENCAVIYCNDGFCELCGYSRAEVMQRPCTCDFLHGPRTQRR
AAAQIAQALLGAEERKVEIAFYRKDGSCFLCLVDVVPVKNEDGAVIMFILNFEVVMEKDMVGSPAHDTNHRGPPTSW
LAPGRAKTFRLKLPALLALTARESSVRSGGAGGAGAPGAVVVDVDLTPAAPSSESLALDEVTAMDNHVAGLGPAEER
RALVGPGSPPRSAPGQLPSPRAHSLNPDASGSSCSLARTRSRESCASVRRASSADDIEAMRAGVLPPPPRHASTGAM
HPLRSGLLNSTSDSDLVRYRTISKIPQITLNFVDLKGDPFLASPTSDREIIAPKIKERTHNVTEKVTQVLSLGADVL
PEYKLQAPRIHRWTILHYSPFKAVWDWLILLLVIYTAVFTPYSAAFLLKETEEGPPATECGYACQPLAVDLIVDIM
FIVDILINFRTTYVNANEEVVSHPGRIAVHYFKGWFLIDMVAAIPFDLLIFGSGSEELIGLLKTARLLRLVRVARKL
DRYSEYGAAVLFLLMCTFALIAHWLACIWYAIGNMEQPHMDSRIGWLHNLGDQIGKPYNSSGLGGPSIKDKYVTALY
FTFSSLTSVGFGNVSPNTNSEKIFSICVMLIGSLMYASIFGNVSAIIQRLYSGTARYHTQMLRVREFIRFHQIPNPL
RQRLEEYFQHAWSYTNGIDMNAVLKGFPECLQADICLHLNRSLLQHCKPFRGATKGCLRALAMKFKTTHAPPGDTLV
HAGDLLTALYFISRGSIEILRGDVVVAILGKNDIFGEPLNLYARPGKSNGDVRALTYCDLHKIHRDDLLEVLDMYPE
FSDHFWSSLEITFNLRDTNMIPGSPGSTELEGGFSRQRKRKLSFRRRTDKDTEQPGEVSALGPGRAGAGPSSRGRPG
GPWGESPSSGPSSPESSEDEGPGRSSSPLRLVPFSSPRPPGEPPGGEPLMEDCEKSSDTCNPLSGAFSGVSNIFSFW
GDSRGRQYQELPRCPAPTPSLLNIPLSSPGRRPRGDVESRLDALQRQLNRLETRLSADMATVLQLLQRQMTLVPPAY
SAVTTPGPGPTSTSPLLPVSPLPTLTLDSLSQVSQFMACEELPPGAPELPQEGPTRRLSLPGQLGALTSQPLHRHGS
DPGS human K,11.2 (HGNC: *KCNH6*) (NCBI: NM_030779) (SEQ ID NO: 56)
MPVRRGHVAPQNTYLDTIIRKFEGQSRKFLIANAQMENCAIIYCNDGFCELFGYSRVEVMQQPCTCDFLTGPNTPSS
AVSRLAQALLGAEECKVDILYYRKDASSFRCLVDVVPVKNEDGAVIMFILNFEDLAQLLAKCSSRSLSQRLLSQSFL
GSEGSHGRPGGPGPGTGRGKYRTISQIPQFTLNFVEFNLEKHRSSSTTEIEIIAPHKVVERTQNVTEKVTQVLSLGA
DVLPEYKLQAPRIHRWTILHYSPFKAVWDWLILLLVIYTAVFTPYSAAFLLSDQDESRRGACSYTCSPLTVVDLIVD
IMFVVDIVINFRTTYVNTNDEVVSHPRRIAVHYFKGWFLIDMVAAIPFDLLIFRTGSDETTTLIGLLKTARLLRLVR
VARKLDRYSEYGAAVLFLLMCTFALIAHWLACIWYAIGNVERPYLEHKIGWLDSLGVQLGKRYNGSDPASGPSVQDK
YVTALYFTFSSLTSVGFGNVSPNTNSEKVFSICVMLIGSLMYASIFGNVSAIIQRLYSGTARYHTQMLRVKEFIRFH
QIPNPLRQRLEEYFQHAWSYTNGIDMNAVLKGFPECLQADICLHLHRALLQHCPAFSGAGKGCLRALAVKFKTTHAP
PGDTLVHLGDVLSTLYFISRGSIEILRDDVVVAILGKNDIFGEPVSLHAQPGKSSADVRALTYCDLHKIQRADLLEV
LDMYPAFAESFWSKLEVTFNLRDAAGGLHSSPRQAPGSQDHQGFFLSDNQSGSPHELGPQFPSKGYSLLGPGSQNSM
GAGPCAPGHPDAAPPLSISDASGLWPELLQEMPPRHSPQSPQEDPDCWPLKLGSRLEQLQAQMNRLESRVSSDLSRI
LQLLQKPMPQGHASYILEAPASNDLALVPIASETTSPGPRLPQGFLPPAQTPSYGDLDDCSPKHRNSSPRMPHLAVA
TDKTLAPSSEQEQPEGLWPPLASPLHPLEVQGLICGPCFSSLPEHLGSVPKQLDFQRHGSDPGFAGSWGH

Figure 14AE human K$_v$11.3 (HGNC: *KCNH7*) (NCBI: NM_033272) (SEQ ID NO: 57)

MPVRRGHVAPQNTFLGTIIRKFEGQNKKFIIANARVQNCAIIYCNDGFCEMTGFSRPDVMQKPCTCDFLHGPETKRH
DIAQIAQALLGSEERKVEVTYYHKNGSTFICNTHIIPVKNQEGVAMMFIINFEYVTDNENAATPERVNPILPIKTVN
RKFFGFKFPGLRVLTYRKQSLPQEDPDVVVIDSSKHSDDSVAMKHFKSPTKESCSPSEADDTKALIQPSKCSPLVNI
SGPLDHSSPKRQWDRLYPDMLQSSSQLSHSRSPESLCSIRRASSVHDIEGFGVHPKNIFRDRHASEDNGRNVKGPFN
HIKSSLLGSTSDSNLNKYSTINKIPQLTLNFSEVKTEKKNSSPPSSDKTIIAPKVKDRTHNVTEKVTQVLSLGADVL
PEYKLQTPRINKFTILHYSPFKAVWDWLILLLVIYTAIFTPYSAAFLLNDREEQKRRECGYSCSPLNVVDLIVDIMF
IIDILINFRTTYVNQNEEVVSDPAKIAIHYFKGWFLIDMVAAIPFDLLIFGSGSDETTTLIGLLKTARLLRLVRVAR
KLDRYSEYGAAVLMLLMCIFALIAHWLACIWYAIGNVERPYLTDKIGWLDSLGQQIGKRYNDSDSSSGPSIKDKYVT
ALYFTFSSLTSVGFGNVSPNTNSEKIFSICVMLIGSLMYASIFGNVSAIIQRLYSGTARYHMQMLRVKEFIRFHQIP
NPLRQRLEEYFQHAWTYTNGIDMNMVLKGFPECLQADICLHLNQTLLQNCKAFRGASKGCLRALAMKFKTTHAPPGD
TLVHCGDVLTALYFLSRGSIEILKDDIVVAILGKNDIFGEMVHLYAKPGKSNADVRALTYCDLHKIQREDLLEVLDM
YPEFSDHFLTNLELTFNLRHESAKADLLRSQSMNDSEGDNCKLRRRKLSFESEGEKENSTNDPEDSADTIRHYQSSK
RHFEEKKSRSSSFISSIDDEQKPLFSGIVDSSPGIGKASGLDFEETVPTSGRMHIDKRSHSCKDITDMRSWERENAH
PQPEDSSPSALQRAAWGISETESDLTYGEVEQRLDLLQEQLNRLESQMTTDIQTILQLLQKQTTVVPPAYSMVTAGS
EYQRPIIQLMRTSQPEASIKTDRSFSPSSQCPEFLDLEKSKLKSKESLSSGVHLNTASEDNLTSLLKQDSDLSLELH
LRQRKTYVHPIRHPSLPDSSLSTVGIVGLHRHVSDPGLPGK human K$_v$12.1 (HGNC: *KCNH8*) (NCBI: NM_144633) (SEQ ID NO: 58)

MPVMKGLLAPQNTFLDTIATRFDGTHSNFILANAQVAKGFPIVYCSDGFCELAGFARTEVMQKSCSCKFLFGVETNE
QLMLQIEKSLEEKTEFKGEIMFYKKNGSPFWCLLDIVPIKNEKGDVVLFLASFKDITDTKVKITPEDKKEDKVKGRS
RAGTHFDSARRRSRAVLYHISGHLQRREKNKLKINNNVFVDKPAFPEYKVSDAKKSKFILLHFSTFKAGWDWLILLA
TFYVAVTVPYNVCFIGNDDLSTTRSTTVSDIAVEILFIIDIILNFRTTYVSKSGQVIFEARSICIHYVTTWFIIDLI
AALPFDLLYAFNVTVVSLVHLLKTVRLLRLLRLLQKLDRYSQHSTIVLTLLMSMFALLAHWMACIWYVIGKMEREDN
SLLKWEVGWLHELGKRLESPYYGNNTLGGPSIRSAYIAALYFTLSSLTSVGFGNVSANTDAEKIFSICTMLIGALMH
ALVFGNVTAIIQRMYSRWSLYHTRTKDLKDFIRVHHLPQQLKQRMLEYFQTTWSVNNGIDSNELLKDFPDELRSDIT
MHLNKEILQLSLFECASRGCLRSLSLHIKTSFCAPGEYLLRQGDALQAIYFVCSGSMEVLKDSMVLAILGKGDLIGA
NLSIKDQVIKTNADVKALTYCDLQCIILKGLFEVLDLYPEYAHKFVEDIQHDLTYNLREGHESDVISRLSNKSMVSQ
SEPKGNGNINKRLPSIVEDEEEEEGEEEEAVSLSPICTRGSSSRNKKVGSNKAYLGLSLKQLASGTVPFHSPIRVS
RSNSPKTKQEIDPPNHNKRKEKNLKLQLSTLNNAGPPDLSPRIVDGIEDGNSSEESQTFDFGSERIRSEPRISPPLG
DPEIGAAVLFIKAEETKQQINKLNSEVTTLTQEVSQLGKDMRNVIQLLENVLSPQQPSRFCSLHSTSVCPSRESLQT
RTSWSAHQPCLHLQTGGAAYTQAQLCSSNITSDIWSVDPSSVGSSPQRTGAHEQNPADSELYHSPSLDYSPSHYQVV
QEGHLQFLRCISPHSDSTLTPLQSISATLSSSVCSSSETSLHLVLPSRSEEGSFSQGTVSSFSLENLPGSWNQEGMA
SASTKPLENLPLEVVTSTAEVKDNKAINV

Figure 14AF human K$_v$12.2 (HGNC: *KCNH3*) (NCBI: NM_012284) (SEQ ID NO: 59)
MPAMRGLLAPQNTFLDTIATRFDGTHSNFVLGNAQVAGLFPVVYCSDGFCDLTGFSRAEVMQRGCACSFLYGPDTSE
LVRQQIRKALDEHKEFKAELILYRKSGLPFWCLLDVIPIKNEKGEVALFLVSHKDISETKNRGGPDRWKETGGGRRR
YGRARSKGFNANRRRSRAVLYHLSGHLQKQPKGKHKLNKGVFGEKPNLPEYKVAAIRKSPFILLHCGALRATWDGFI
LLATLYVAVTVPYSVCVSTAREPSAARGPPSVCDLAVEVLFILDIVLNFRTTFVSKSGQVVFAPKSICLHYVTTWFL
LDVIAALPFDLLHAFKVNVYFGAHLLKTVRLLRLLRLLPRLDRYSQYSAVVLTLLMAVFALLAHWVACVWFYIGQRE
IESSESELPEIGWLQELARRLETPYYLVGRRPAGGNSSGQSDNCSSSSEANGTGLELLGGPSLRSAYITSLYFALSS
LTSVGFGNVSANTDTEKIFSICTMLIGALMHAVVFGNVTAIIQRMYARRFLYHSRTRDLPDYIRIHRIPKPLKQRML
EYFQATWAVNNGIDTTELLQSLPDELRADIAMHLHKEVLQLPLFEAASRGCLRALSLALRPAFCTPGEYLIHQGDAL
QALYFVCSGSMEVLKGGTVLAILGKGDLIGCELPRREQVVKANADVKGLTYCVLQCLQLAGLHDSLALYPEFAPRFS
RGLRGELSYNLGAGGGSAEVDTSSLSGDNTLMSTLEEKETDGEQGPTVSPAPADEPSSPLLSPGCTSSSSAAKLLSP
RRTAPRPRLGGRGRPGRAGALKAEAGPSAPPRALEGLRLPPMPWNVPPDLSPRVVDGIEDGCGSDQPKFSFRVGQSG
PECSSSPSPGPESGLLTVPHGPSEARNTDTLDKLRQAVTELSEQVLQMREGLQSLRQAVQLVLAPHREGPCPRASGE
GPCPASTSGLLQPLCVDTGASSYCLQPPAGSVLSGTWPHPRPGPPPLMAPWPWGPPASQSSPWPRATAFWTSTSDSE
PPASGDLCSEPSTPASPPPSEEGARTGPAEPVSQAEATSTGEPPPGSGGLALPWDPHSLEMVLIGCHGSGTVQWTQE
EGTGV human K$_v$12.3 (HGNC: *KCNH4*) (NCBI: NM_012285) (SEQ ID NO: 60)
MPVMKGLLAPQNTFLDTIATRFDGTHSNFLLANAQGTRGFPIVYCSDGFCELTGYGRTEVMQKTCSCRFLYGPETSE
PALQRLHKALEGHQEHRAEICFYRKDGSAFWCLLDMMPIKNEMGEVVLFLFSFKDITQSGSPGLGPQGGRGDSNHEN
SLGRRGATWKFRSARRRSPTVLHRLTGHFGRRGQGGMKANNNVFEPKPSVPEYKVASVGGSRCLLLHYSVSKAIWDG
LILLATFYVAVTVPYNVCFSGDDDTPITSRHTLVSDIAVEMLFILDIILNFRTTYVSQSGQVISAPRSIGLHYLATW
FFIDLIAALPFDLLYIFNITVTSLVHLLKTVRLLRLLRLLQKLERYSQCSAVVLTLLMSVFALLAHWMACIWYVIGR
REMEANDPLLWDIGWLHELGKRLEVPYVNGSVGGPSRRSAYIAALYFTLSSLTSVGFGNVCANTDAEKIFSICTMLI
GALMHAVVFGNVTAIIQRMYSRRSLYHSRMKDLKDFIRVHRLPRPLKQRMLEYFQTTWAVNSGIDANELLRDFPDEL
RADIAMHLNREILQLPLFGAASRGCLRALSLHIKTSFCAPGEYLLRRGDALQAHYYVCSGSLEVLRDNMVLAILGKG
DLIGADIPEPGQEPGLGADPNFVLKTSADVKALTYCGLQQLSSRGLAEVLRLYPEYGAAFRAGLPRDLTFNLRQGSD
TSGLSRFSRSPRLSQPRSESLGSSSDKTLPSITEAESGAEPGGGPRPRRPLLLPNLSPARPRGSLVSLLGEELPPFS
ALVSSPSLSPSLSPALAGQGHSASPHGPPRCSAAWKPPQLLIPPLGTFGPPDLSPRIVDGIEDSGSTAEAPSFRFSR
RPELPRPRSQAPPTGTRPSPELASEAEEVKEKVCRLNQEISRLNQEVSQLSRELRHIMGLLQARLGPPGHPAGSAWT
PDPPCPQLRPPCLSPCASRPPPSLQDTTLAEVHCPASVGTMETGTALLDLRPSILPPYPSEPDPLGPSPVPEASPPT
PSLLRHSFQSRSDTFH

Figure 14AG human HCN1 (HGNC: HCN1) (NCBI: NM_021072) (SEQ ID NO: 61)
MEGGGKPNSSSNSRDDGNSVFPAKASATGAGPAAAEKRLGTPPGGGGAGAKEHGNSVCFKVDGGGGGGGGGGGEEP
AGGFEDAEGPRRQYGFMQRQFTSMLQPGVNKFSLRMFGSQKAVEKEQERVKTAGFWIIHPYSDFRFYWDLIMLIMMV
GNLVIIPVGITFFTEQTTTPWIIFNVASDTVFLLDLIMNFRTGTVNEDSSEIILDPKVIKMNYLKSWFVVDFISSIP
VDYIFLIVEKGMDSEVYKTARALRIVRFTKILSLLRLLRLSRLIRYIHQWEEIFHMTYDLASAVVRIFNLIGMMLLL
CHWDGCLQFLVPLLQDFPPDCWVSLNEMVNDSWGKQYSYALFKAMSHMLCIGYGAQAPVSMSDLWITMLSMIVGATC
YAMFVGHATALIQSLDSSRRQYQEKYKQVEQYMSFHKLPADMRQKIHDYYEHRYQGKIFDEENILNELNDPLREEIV
NFNCRKLVATMPLFANADPNFVTAMLSKLRFEVFQPGDYIIREGAVGKKMYFIQHGVAGVITKSSKEMKLTDGSYFG
EICLLTKGRRTASVRADTYCRLYSLSVDNFNEVLEEYPMMRRAFETVAIDRLDRIGKKNSILLQKFQKDLNTGVFNN
QENEILKQIVKHDREMVQAIAPINYPQMTTLNSTSSTTTPTSRMPTQSPPVYTATSLSHSNLHSPSPSTQTPQPSAI
LSPCSYTTAVCSPPVQSPLAARTFHYASPTASQLSLMQQQPQQQVQQSQPPQTQPQQPSPQPQTPGSSTPKNEVHKS
TQALHNTNLTREVRPLSASQPSLPHEVSTLISRPHPTVGESLASIPQPVTAVPGTGLQAGGRSTVPQRVTLFRQMSS
GAIPPNRGVPPAPPPPAAALPRESSSVLNTDPDAEKPRFASNL human HCN2 (HGNC: HCN2) (NCBI: NM_001194) (SEQ ID NO: 62)
MDARGGGGRPGESPGATPAPGPPPPPPPAPPQQQPPPPPPAPPPGPGPAPPQHPPRAEALPPEAADEGGPRGRLRS
RDSSCGRPGTPGAASTAKGSPNGECGRGEPQCSPAGPEGPARGPKVSFSCRGAASGPAPGPGPAEEAGSEEAGPAGE
PRGSQASFMQRQFGALLQPGVNKFSLRMFGSQKAVEREQERVKSAGAWIIHPYSDFRFYWDFTMLLFMVGNLIIIPV
GITFFKDETTAPWIVFNVVSDTFFLMDLVLNFRTGIVIEDNTEIILDPEKIKKKYLRTWFVVDFVSSIPVDYIFLIV
EKGIDSEVYKTARALRIVRFTKILSLLRLLRLSRLIRYIHQWEEIFHMTYDLASAVMRICNLISMMLLLCHWDGCLQ
FLVPMLQDFPRNCWVSINGMVNHSWSELYSFALFKAMSHMLCIGYGRQAPESMTDIWLTMLSMIVGATCYAMFIGHA
TALIQSLDSSRRQYQEKYKQVEQYMSFHKLPADFRQKIHDYYEHRYQGKMFDEDSILGELNGPLREEIVNFNCRKLV
ASMPLFANADPNFVTAMLTKLKFEVFQPGDYIIREGTIGKKMYFIQHGVVSVLTKGNKEMKLSDGSYFGEICLLTRG
RRTASVRADTYCRLYSLSVDNFNEVLEEYPMMRRAFETVAIDRLDRIGKKNSILLHKVQHDLNSGVFNNQENAIIQE
IVKYDREMVQQAELGQRVGLFPPPPPPPQVTSAIATLQQAAAMSFCPQVARPLVGPLALGSPRLVRRPPPGPAPAAA
SPGPPPPASPPGAPASPRAPRTSPYGGLPAAPLAGPALPARRLSRASRPLSASQPSLPHGAPGPAASTRPASSSTPR
LGPTPAARAAAPSPDRRDSASPGAAGGLDPQDSARSRLSSNL

Figure 14AH human HCN3 (HGNC: HCN3) (NCBI: NM_020897) (SEQ ID NO: 63)

MEAEQRPAAGASEGATPGLEAVPPVAPPPATAASGPIPKSGPEPKRRHLGTLLQPTVNKFSLRVFGSHKAVEIEQER
VKSAGAWIIHPYSDFRFYWDLIMLLLMVGNLIVLPVGITFFKEENSPPWIVFNVLSDTFFLLDLVLNFRTGIVVEEG
AEILLAPRAIRTRYLRTWFLVDLISSIPVDYIFLVVELEPRLDAEVYKTARALRIVRFTKILSLLRLLRLSRLIRYI
HQWEEIFHMTYDLASAVVRIFNLIGMMLLLCHWDGCLQFLVPMLQDFPPDCWVSINHMVNHSWGRQYSHALFKAMSH
MLCIGYGQQAPVGMPDVWLTMLSMIVGATCYAMFIGHATALIQSLDSSRRQYQEKYKQVEQYMSFHKLPADTRQRIH
EYYEHRYQGKMFDEESILGELSEPLREEIINFTCRGLVAHMPLFAHADPSFVTAVLTKLRFEVFQPGDLVVREGSVG
RKMYFIQHGLLSVLARGARDTRLTDGSYFGEICLLTRGRRTASVRADTYCRLYSLSVDHFNAVLEEFPMMRRAFETV
AMDRLLRIGKKNSILQRKPSEPSPGSSGGIMEQHLVQHDRDMARGVRGRAPSTGAQLSGKPVLWEPLVHAPLQAAAV
TSNVAIALTHQRGPLPLSPDSPATLLARSAWRSAGSPASPLVPVRAGPWASTSRLPAPPARTLHASLSRAGRSQVSL
LGPPPGGGGRRLGPRGRPLSASQPSLPQRATGDGSPGRKGSGSERLPPSGLLAKPPRTAQPPRPPVPEPATPRGLQL
SANM human HCN4 (HGNC: HCN4) (NCBI: NM_005477) (SEQ ID NO: 64)

MDKLPPSMRKRLYSLPQQVGAKAWIMDEEEDAEEEGAGGRQDPSRRSIRLRPLPSPSPSAAAGGTESRSSALGAADS
EGPARGAGKSSTNGDCRRFRGSLASLGSRGGGSGGTGSGSSHGHLHDSAEERRLIAEGDASPGEDRTPPGLAAEPER
PGASAQPAASPPPPQQPPQPASASCEQPSVDTAIKVEGGAAAGDQILPEAEVRLGQAGFMQRQFGAMLQPGVNKFSL
RMFGSQKAVEREQERVKSAGFWIIHPYSDFRFYWDLTMLLLMVGNLIIIPVGITFFKDENTTPWIVFNVVSDTFFLI
DLVLNFRTGIVVEDNTEIILDPQRIKMKYLKSWFMVDFISSIPVDYIFLIVETRIDSEVYKTARALRIVRFTKILSL
LRLLRLSRLIRYIHQWEEIFHMTYDLASAVVRIVNLIGMMLLLCHWDGCLQFLVPMLQDFPDDCWVSINNMVNNSWG
KQYSYALFKAMSHMLCIGYGRQAPVGMSDVWLTMLSMIVGATCYAMFIGHATALIQSLDSSRRQYQEKYKQVEQYMS
FHKLPPDTRQRIHDYYEHRYQGKMFDEESILGELSEPLREEIINFNCRKLVASMPLFANADPNFVTSMLTKLRFEVF
QPGDYIIREGTIGKKMYFIQHGVVSVLTKGNKETKLADGSYFGEICLLTRGRRTASVRADTYCRLYSLSVDNFNEVL
EEYPMMRRAFETVALDRLDRIGKKNSILLHKVQHDLNSGVFNYQENEIIQQIVQHDREMAHCAHRVQAAASATPTPT
PVIWTPLIQAPLQAAAATTSVAIALTHHPRLPAAIFRPPPGSGLGNLGAGQTPRHLKRLQSLIPSALGSASPASSPS
QVDTPSSSSFHIQQLAGFSAPAGLSPLLPSSSSSPPPGACGSPSAPTPSAGVAATTIAGFGHFHKALGGSLSSSDSP
LLTPLQPGARSPQAAQPSPAPPGARGGLGLPEHFLPPPPSSRSPSSSPGQLGQPPGELSLGLATGPLSTPETPPRQP
EPPSLVAGASGGASPVGFTPRGGLSPPGHSPGPPRTFPSAPPRASGSHGSLLLPPASSPPPPQVPQRRGTPPLTPGR
LTQDLKLISASQPALPQDGAQTLRRASPHSSGESMAAFPLFPRAGGGSGGSSGGLGPPGRPYGAIPGQHVTLPRK
TSSGSLPPPLSLFGARATSSGGPPLTAGPQREPGARPEPVRSKLPSNL

Figure 14AI human CatSper1 (HGNC: CatSper1) (GENBANK TRANSLATION: AF407333) (SEQ ID NO: 65)

MDQNSVPEKAQNEADTNNADRFFRSHSSPPHHRPGHSRALHHYELHHHGVPHQRGESHHPPEFQDFHDQALSSHVHQ
SHHHSEARNHGRAHGPTGFGLAPSQGAVPSHRSYGEDYHDELQRDGRRHHDGSQYGGFHQQSDSHYHRGSHHGRPQY
LGENLSHYSSGVPHHGEASHHGGSYLPHGPNPYSESFHHSEASHLSGLQHDESQHHQVPHRGWPHHHQVHHHGRSRH
HEAHQHGKSPHHGETISPHSSVGSYQRGISDYHSEYHQGDHHPSEYHHGDHPHHTQHHYHQTHRHRDYHQHQDHHGA
YHSSYLHGDYVQSTSQLSIPHTSRSLIHDAPGPAASRTGVFPYHVAHPRGSAHSMTRSSSTIRSRVTQMSKKVHTQD
ISTKHSEDWGKEEGQFQKRKTGRLQRTRKKGHSTNLFQWLWEKLTFLIQGFREMIRNLTQSLAFETFIFFVVCLNTV
MLVAQTFAEVEIRGEWYFMALDSIFFCIYVVEALLKIIALGLSYFFDFWNNLDFFIMAMAVLDFLLMQTHSFAIYHQ
SLFRILKVFKSLRALRAIRVLRRLSFLTSVQEVTGTLGQSLPSIAAILILMFTCLFLFSAVLRALFRKSDPKRFQNI
FTTIFTLFTLLTLDDWSLIYMDSRAQGAWYIIPILIIYIIQYFIFLNLVITVLVDSFQTALFKGLEKAKQERAARI
QEKLLEDSLTELRAAEPKEVASEGTMLKRLIEKKFGTMTEKQQELLFHYLQLVASVEQEQQKFRSQAAVIDEIVDTT
FEAGEEDFRN human CatSper2 (HGNC: None) (GENBANK TRANSLATION: AF411817) (SEQ ID NO: 66)
MAAYQQEEQMQLPRADAIRSRLIDTFSLIEHLQGLSQAVPRHTIRELLDPSRQKKLVLGDQHQLVRFSIKPQRIEQI
SHAQRLLSRLHVRCSQRPPLSLWAGWVLECPLFKNFIIFLVFLNTIILMVEIELLESTNTKLWPLKLTLEVAAWFIL
LIFILEILLKWLSNFSVFWKSAWNVFDFVVTMLSLLPEVVVLVGVTGQSVWLQLLRICRVLRSLKLLAQFRQIQIII
LVLVRALKSMTFLLMLLLIFFYIFAVTGVYVFSEYTRSPRQDLEYHVFFSDLPNSLVTVFILFTLDHWYALLQDVWK
VPEVSRIFSSIYFILWLLLGSIIFRSIIVAMMVTNFQNIRKELNEEMARREVQLKADMFKRQIIQRRKNMSHEALTS
SHSKIEDRGASQQRESLDLSEVSEVESNYGATEEDLITSASKTEETLSKKREYQSSSCVSSTSSSYSSSSESRFSES
IGRLDWETLVHENLPGLMEMDQDDRVWPRDSLFRYFELLEKLQYNLEERKKLQEFAVQALMNLEDK human CatSper3 (HGNC: None) (GENBANK TRANSLATION: AF432876) (SEQ ID NO: 67)
MSQHRHQRHSRVISSSPVDTTSVGFCPTFKKFKRNDDECRAFVKRVIMSRFFKIIMISTVTSNAFFMALWTSYDIRY
RLFRLLEFSEIFFVSICTSELSMKVYVDPINYWKNGYNLLDVIIIIVMFLPYALRQLMGKQFTYLYIADGMQSLRIL
KLIGYSQGIRTLITAVGQTVYTVASVLLLLFLLMYIFAILGFCLFGSPDNGDHDNWGNLAAAFFTLFSLATVDGWTD
LQKQLDNREFALSRAFTIIFILLASFIFLNMFVGVMIMHTEDSIRKFERELMLEQQEMLGEKQVILQRQQEEISRL
MHIQKNADCTSFSELVENFKKTLSHTDPMVLDDFGTSLPFIDIYFSTLDYQDTTVHKLQELYYEIVHVLSLMLEDLP
QEKPQSLEKVDEK

Figure 14AJ human CatSper4 (HGNC: None) (GENBANK TRANSLATION: BN000273) (SEQ ID NO: 68)
MRDNEKAWWQQWTSHTGLEGWGGTQEDRMGFGGAVAALRGRPSPLQSTIHESYGRPEEQVLINRQEITNKADAWDMQ
EFITHMYIKQLLRHPAFQLLLALLLVINAITIALRTNSYLDQKHYELFSTIDDIVLTILLCEVLLGWLNGFWIFWKD
GWNILNFIIVFILLLRFFINEINIPSINYTLRALRLVHVCMAVEPLARIIRVILQSVPDMANIMVLILFFMLVFSVF
GVTLFGAFVPKHFQNIQVALYTLFICITQDGWVDIYSDFQTEKREYAMEIGGAIYFTIFITIGAFIGINLFVIVVTT
NLEQMMKAGEQGQQQRITFSETGAEEEEENDQLPLVHCVVARSEKSGLLQEPLAGGPLSNLSENTCDNFCLVLEAIQ
ENLRQYKEIRDELNMIVEEVRAIRFNQEQESEVLNRRSSTSGSLETTSSKDIRQMSQQQDLLSALVSMEKVHDSSSQ
ILLKKHKSSH human Hv1 (HGNC: HVCN1) (NCBI: NP_001035196.1) (SEQ ID NO: 69)
MATWDEKAVTRRPAKVAPAERMSKFLRHFTVVGDDYHAWNINYKKWENEEEEEEEEQPPPTPVSGEEGRAAAPDVAPA
PGPAPRAPLDFRGMLRKLFSSHRFQVIIICLVVLDALLVLAELILDLKIIQPDKNNYAAMVFHYMSITILVFFMMEI
IFKLFVFRLEFFHHKFEILDAVVVVVSFILDIVLLFQEHQFEALGLLILLRLWRVARIINGIIISVKTRSERQLLRL
KQMNVQLAAKIQHLEFSCSEKEQEIERLNKLLRQHGLLGEVN human K$_{Ca}$1.1 (HGNC: KCNMA1) (NCBI: NM_001014797) (SEQ ID NO: 70)
MANGGGGGGGSSGGGGGGGGSSLRMSSNIHANHLSLDASSSSSSSSSSSSSSSSSSSSSVHEPKMDALIIPVTMEV
PCDSRGQRMWWAFLASSMVTFFGGLFIILLWRTLKYLWTVCCHCGGKTKEAQKINNGSSQADGTLKPVDEKEEAVAA
EVGWMTSVKDWAGVMISAQTLTGRVLVVLVFALSIGALVIYFIDSSNPIESCQNFYKDFTLQIDMAFNVFFLLYFGL
RFIAANDKLWFWLEVNSVVDFFTVPPVFVSVYLNRSWLGLRFLRALRLIQFSEILQFLNILKTSNSIKLVNLLSIFI
STWLTAAGFIHLVENSGDPWENFQNNQALTYWECVYLLMVTMSTVGYGDVYAKTTLGRLFMVFFILGGLAMFASYVP
EIIELIGNRKKYGGSYSAVSGRKHIVVCGHITLESVSNFLKDFLHKDRDDVNVEIVFLHNISPNLELEALFKRHFTQ
VEFYQGSVLNPHDLARVKIESADACLILANKYCADPDAEDASNIMRVISIKNYHPKIRIITQMLQYHNKAHLLNIPS
WNWKEGDDAICLAELKLGFIAQSCLAQGLSTMLANLFSMRSFIKIEEDTWQKYYLEGVSNEMYTEYLSSAFVGLSFP
TVCELCFVKLKLLMIAIEYKSANRESRSRKRILINPGNHLKIQEGTLGFFIASDAKEVKRAFFYCKACHDDITDPKR
IKKCGCKRLEDEQPSTLSPKKKQRNGGMRNSPNTSPKLMRHDPLLIPGNDQIDNMDSNVKKYDSTGMFHWCAPKEIE
KVILTRSEAAMTVLSGHVVVCIFGDVSSALIGLRNLVMPLRASNFHYHELKHIVFVGSIEYLKREWETLHNFPKVSI
LPGTPLSRADLRAVNINLCDMCVILSANQNNIDDTSLQDKECILASLNIKSMQFDDSIGVLQANSQGFTPPGMDRSS
PDNSPVHGMLRQPSITTGVNIPIITELVNDTNVQFLDQDDDDPDTELYLTQPFACGTAFAVSVLDSLMSATYFNDN
ILTLIRTLVTGGATPELEALIAEENALRGGYSTPQTLANRDRCRVAQLALLDGPFADLGDGGCYGDLFCKALKTYNM
LCFGIYRLRDAHLSTPSQCTKRYVITNPPYEFELVPTDLIFCLMQFDHNAGQSRASLSHSSHSSQSSSKKSSSVHSI
PSTANRQNRPKSRESRDKQNRKEMVYR

Figure 14AK human K$_{Ca}$4.1 (HGNC: KCNT1) (NCBI: NM_020822) (SEQ ID NO: 71)

MPLPDGARTPGGVCREARGGGYTNRTFEFDDGQCAPRRPCAGDGALLDTAGFKMSDLDSEVLPLPPRYRFRDLLGD
PSFQNDDRVQVEFYVNENTFKERLKLFFIKNQRSSLRIRLFNFSLKLLTCLLYIVRVLLDDPALGIGCWGCPKQNYS
FNDSSSEINWAPILWVERKMTLWAIQVIVAIISFLETMLLIYLSYKGNIWEQIFRVSFVLEMINTLPFIITIFWPPL
RNLFIPVFLNCWLAKHALENMINDFHRAILRTQSAMFNQVLILFCTLLCLVFTGTCGIQHLERAGENLSLLTSFYFC
IVTFSTVGYGDVTPKIWPSQLLVVIMICVALVVLPLQFEELVYLWMERQKSGGNYSRHRAQTEKHVVLCVSSLKIDL
LMDFLNEFYAHPRLQDYYVVILCPTEMDVQVRRVLQIPLWSQRVIYLQGSALKDQDLMRAKMDNGEACFILSSRNEV
DRTAADHQTILRAWAVKDFAPNCPLYVQILKPENKFHVKFADHVVCEEECKYAMLALNCICPATSTLITLLVHTSRG
QEGQESPEQWQRMYGRCSGNEVYHIRMGDSKFFREYEGKSFTYAAFHAHKKYGVCLIGLKPEDNKSILLNPGPRHIL
AASDTCFYINITKEENSAFIFKQEEKRKKRAFSGQGLHEGPARLPVHSIIASMGTVAMDLQGTEHRPTQSGGGGGS
KLALPTENGSGSRRPSIAPVLELADSSALLPCDLLSDQSEDEVTPSDDEGLSVVEYVKGYPPNSPYIGSSPTLCHLL
PVKAPFCCLRLDKGCKHNSYEDAKAYGFKNKLIIVSAETAGNGLYNFIVPLRAYYRSRKELNPIVLLLDNKPDHHFL
EAICCFPMVYYMEGSVDNLDSLLQCGIIYADNLVVVDKESTMSAEEDYMADAKTIVNVQTMFRLFPSLSITTELTHP
SNMRFMQFRAKDSYSLALSKLEKRERENGSNLAFMFRLPFAAGRVFSISMLDTLLYQSFVKDYMITITRLLLGLDTT
PGSGYLCAMKITEGDLWIRTYGRLFQKLCSSSAEIPIGIYRTESHVFSTSEPHDLRAQSQISVNVEDCEDTREVKGP
WGSRAGTGGSSQGRHTGGGDPAEHPLLRRKSLQWARRLSRKAPKQAGRAAAAEWISQQRLSLYRRSERQELSELVKN
RMKHLGLPTTGYDEMNDHQNTLSYVLINPPPDTRLEPSDIVYLIRSDPLAHVASSSQSRKSSCSHKLSSCNPETRDE
TQL human K$_{Ca}$4.2 (HGNC: KCNT2) (NCBI: NM_198503) (SEQ ID NO: 72)

MVDLESEVPPLPPRYRFRDLLLGDQGWQNDDRVQVEFYMNENTFKERLKLFFIKNQRSSLRIRLFNFSLKLLSCLLY
IIRVLLENPSQGNEWSHIFWVNRSLPLWGLQVSVALISLFETILLGYLSYKGNIWEQILRIPFILEIINAVPFIISI
FWPSLRNLFVPVFLNCWLAKHALENMINDLHRAIQRTQSAMFNQVLILISTLLCLIFTCICGIQHLERIGKKLNLFD
SLYFCIVTFSTVGFGDVTPETWSSKLFVVAMICALVVLPIQFEQLAYLWMERQKSGGNYSRHRAQTEKHVVLCVSS
LKIDLLMDFLNEFYAHPRLQDYYVVILCPTEMDVQVRRVLQIPMWSQRVIYLQGSALKDQDLLRAKMDDAEACFILS
SRCEVDRTSSDHQTILRAWAVKDFAPNCPLYVQILKPENKFHIKFADHVVCEEEFKYAMLALNCICPATSTLITLLV
HTSRGQEGQQSPEQWQKMYGRCSGNEVYHIVLEESTFFAEYEGKSFTYASFHAHKKFGVCLIGVRREDNKNILLNPG
PRYIMNSTDICFYINITKEENSAFKNQDQQRKSNVSRSFYHGPSRLPVHSIIASMGTVAIDLQDTSCRSASGPTLSL
PTEGSKEIRRPSIAPVLEVADTSSIQTCDLLSDQSEDETTPDEEMSSNLEYAKGYPPYSPYIGSSPTFCHLLHEKVP
FCCLRLDKSCQHNYYEDAKAYGFKNKLIIVAAETAGNGLYNFIVPLRAYYRPKKELNPIVLLLDNPPDMHFLDAICW
FPMVYYMVGSIDNLDDLLRCGVTFAANMVVVDKESTMSAEEDYMADAKTIVNVQTLFRLFSSLSIITELTHPANMRF
MQFRAKDCYSLALSKLEKKERERGSNLAFMFRLPFAAGRVFSISMLDTLLYQSFVKDYMISITRLLLGLDTTPGSGF
LCSMKITADDLWIRTYARLYQKLCSSTGDVPIGIYRTESQKLTTSESQISISVEEWEDTKDSKEQGHHRSNHRNSTS
SDQSDHPLLRRKSMQWARRLSRKGPKHSGKTAEKITQQRLNLYRRSERQELAELVKNRMKHLGLSTVGYDEMNDHQS
TLSYILINPSPDTRIELNDVVYLIRPDPLAYLPNSEPSRRNSICNVTGQDSREETQL

Figure 14AL human TPC1 (HGNC: None ) (NCBI: NP_001137291.1) (SEQ ID NO: 73)
MESCYIAQAGLELLGSSSSPTLTSQSAEITEDASNGGVSEQHPWPSGFERELKPETISSPGYHILRATGEENMAVSL
DDDVPLILTLDEGGSAPLAPSNGLGQEELPSKNGGSYAIHDSQAPSLSSGGESSPSSPAHNWEMNYQEAAIYLQEGE
NNDKFFTHPKDAKALAAYLFAHNHLFYLMELATALLLLLLSLCEAPAVPALRLGIYVHATLELFALMVVVFELCMKL
RWLGLHTFIRHKRTMVKTSVLVVQFVEAIVVLVRQMSHVRVTRALRCIFLVDCRYCGGVRRNLRQIFQSLPPFMDIL
LLLLFFMIIFAILGFYLFSPNPSDPYFSTLENSIVSLFVLLTTANFPDVMMPSYSRNPWSCVFFIVYLSIELYFIMN
LLAVVFDTFNDIEKRKFKSLLLHKRTAIQHAYRLLISQRRPAGISYRQFEGLMRFYKPRMSARERYLTFKALNQNN
TPLLSLKDFYDIYEVAALKWKAKKNREHWFDELPRTALLIFKGINILVKSKAFQYFMYLVVAVNGVWILVETFMLKG
GNFFSKHVPWSYLVFLTIYGVELFLKVAGLGPVEYLSSGWNLFDFSVTVFAFLGLLALALNMEPFYFIVVLRPLQLL
RLFKLKERYRNVLDTMFELLPRMASLGLTLLIFYYSFAIVGMEFFCGIVFPNCCNTSTVADAYRWRNHTVGNRTVVE
EGYYYLNNFDNILNSFVTLFELTVVNNWYIIMEGVTSQTSHWSRLYFMTFYIVTMVVMTIIVAFILEAFVFRMNYSR
KNQDSEVDGGITLEKEISKEELVAVLELYREARGASSDVTRLLETLSQMERYQQHSMVFLGRRSRTKSDLSLKMYQE
EIQEWYEEHAREQEQQRQLSSSAAPAAQQPPGSRQRSQTVT

Figure 14AM

```
Shaker    ------------------------------------------------------
Nav1.1    ------------------------------------------------------
Nav1.2    ------------------------------------------------------
Nav1.3    ------------------------------------------------------
Nav1.4    ------------------------------------------------------
Nav1.5    ------------------------------------------------------
Nav1.6    ------------------------------------------------------
Nav1.7    ------------------------------------------------------
Nav1.8    ------------------------------------------------------
Nav1.9    ------------------------------------------------------
Cav1.1    ------------------------------------------------------
Cav1.2    ------------------------------------------------------
Cav1.3    ------------------------------------------------------
Cav1.4    ------------------------------------------------------
Cav2.1    ------------------------------------------------------
Cav2.2    ------------------------------------------------------
Cav2.3    ------------------------------------------------------
Cav3.1    MDEEEDGAGAEESGQPRSF-----MRLNDLSGAG----GRPGP----GSAEKDPGS---- 43
Cav3.2    MTE---GARAADEV--RVPLGAPPPGPAALVGASPESPGAPGREAERGSELGVSPSESPA 55
Cav3.3    MAE---SASPPSSS--AA--------APAAEPGVTTEQPGP-------RSPPSSPPGLEEP 41
Kv1.1     ------------------------------------------------------
Kv1.2     ------------------------------------------------------
Kv1.3     ------------------------------------------------------
Kv1.4     ------------------------------------------------------
Kv1.5     ------------------------------------------------------
Kv1.6     ------------------------------------------------------
Kv1.7     ------------------------------------------------------
Kv1.8     ------------------------------------------------------
Kv2.1     ------------------------------------------------------
Kv2.2     ------------------------------------------------------
Kv3.1     ------------------------------------------------------
Kv3.2     ------------------------------------------------------
Kv3.3     ------------------------------------------------------
Kv3.4     ------------------------------------------------------
Kv4.1     ------------------------------------------------------
Kv4.2     ------------------------------------------------------
Kv4.3     ------------------------------------------------------
Kv5.1     ------------------------------------------------------
Kv6.1     ------------------------------------------------------
Kv6.2     ------------------------------------------------------
Kv6.3     ------------------------------------------------------
Kv6.4     ------------------------------------------------------
Kv7.1     ------------------------------------------------------
Kv7.2     ------------------------------------------------------
Kv7.3     ------------------------------------------------------
Kv7.4     ------------------------------------------------------
Kv7.5     ------------------------------------------------------
Kv8.1     ------------------------------------------------------
Kv8.2     ------------------------------------------------------
Kv9.1     ------------------------------------------------------
Kv9.2     ------------------------------------------------------
Kv9.3     ------------------------------------------------------
Kv10.1    ------------------------------------------------------
Kv10.2    ------------------------------------------------------
Kv11.1    ------------------------------------------------------
Kv11.2    ------------------------------------------------------
Kv11.3    ------------------------------------------------------
Kv12.1    ------------------------------------------------------
Kv12.2    ------------------------------------------------------
Kv12.3    ------------------------------------------------------
HCN1      ------------------------------------------------------
HCN2      ------------------------------------------------------
HCN3      ------------------------------------------------------
HCN4      ------------------------------------------------------
```

Figure 15A

```
CatSper1        ------------------------------------------------------------
CatSper2        ------------------------------------------------------------
CatSper3        ------------------------------------------------------------
CatSper4        ------------------------------------------------------------
Hv1             ------------------------------------------------------------
KCa1.1          ------------------------------------------------------------
KCa4.1          -MPLPDGARTPGGV---------CREARGGGYT------NRTFEFDDGQCAPRRPC--  40
KCa4.2          ------------------------------------------------------------
TPC1            ------------------------------------------------------------

Shaker          ------------------------------------------------------------
Nav1.1          ---------------------------------------MEQTVLVPP-GPDSFNF  16
Nav1.2          ---------------------------------------MAQSVLVPP-GPDSFRF  16
Nav1.3          ---------------------------------------MAQALLVPP-GPESFRL  16
Nav1.4          ------------------------------------MARPSLCTLARL-GPECLRP  19
Nav1.5          ---------------------------------------MANFLLPRGT-S--SFRR  15
Nav1.6          ---------------------------------------MAARLLAPP-GPDSFKP  16
Nav1.7          ---------------------------------------MA--MLPPP-GPQSFVH  14
Nav1.8          ---------------------------------------MEFPIGSL-ETNNFRR  15
Nav1.9          ---------------------------------------MDDRCYPVIFPDERNFRP  18
Cav1.1          ------------------------------------------------------------
Cav1.2          ------------------------------MNANAAAGLAPE------HIPT  16
Cav1.3          ------------------------------MMMMMMMKKMQHQPQQQADHAN  22
Cav1.4          ------------------------------MSESEGGKDTTPE---PSPAN  18
Cav2.1          ------------------------------MARFGDEMPARYGGGGSGAAAG  22
Cav2.2          ------------------------------MVRFGDELGGRYGGPGGGERAR  22
Cav2.3          ------------------------------MARFGE---AVVARPGSGDGDS  19
Cav3.1          ADSEAE-------GLPYPALAPVVFFYLSQDSRPRSWCLRTVCNPWFERISMLVILLNCV  96
Cav3.2          AERGAELGADEEQRVPYPALAATVFFCLGQTTRPRSWCLRLVCNPWFEHVSMLVIMLNCV 115
Cav3.3          LDGADP-------HVPHPDLAPIAFFCLRQTTSPRNWCIKMVCNPWFECVSMLVILLNCV  94
Kv1.1           ------------------------------------------------------------
Kv1.2           ------------------------------------------------------------
Kv1.3           ------------------------------------------------------------
Kv1.4           ------------------------------------------------------------
Kv1.5           ------------------------------------------------------------
Kv1.6           ------------------------------------------------------------
Kv1.7           ------------------------------------------------------------
Kv1.8           ------------------------------------------------------------
Kv2.1           ------------------------------------------------------------
Kv2.2           ------------------------------------------------------------
Kv3.1           ------------------------------------------------------------
Kv3.2           ------------------------------------------------------------
Kv3.3           ------------------------------------------------------------
Kv3.4           ------------------------------------------------------------
Kv4.1           ------------------------------------------------------------
Kv4.2           ------------------------------------------------------------
Kv4.3           ------------------------------------------------------------
Kv5.1           ------------------------------------------------------------
Kv6.1           ------------------------------------------------------------
Kv6.2           ------------------------------------------------------------
Kv6.3           ------------------------------------------------------------
Kv6.4           ------------------------------------------------------------
Kv7.1           ------------------------------------------------------------
Kv7.2           ------------------------------------------------------------
Kv7.3           ------------------------------------------------------------
Kv7.4           ------------------------------------------------------------
Kv7.5           ------------------------------------------------------------
Kv8.1           ------------------------------------------------------------
```

Figure 15B

```
Kv8.2      ------------------------------------------------------
Kv9.1      ------------------------------------------------------
Kv9.2      ------------------------------------------------------
Kv9.3      ------------------------------------------------------
Kv10.1     ------------------------------------------------------
Kv10.2     ------------------------------------------------------
Kv11.1     ------------------------------------------------------
Kv11.2     ------------------------------------------------------
Kv11.3     ------------------------------------------------------
Kv12.1     ------------------------------------------------------
Kv12.2     ------------------------------------------------------
Kv12.3     ------------------------------------------------------
HCN1       ----------------------------MEGGGKPNS---------------    9
HCN2       --------------------MDARGGGGRPGESPGATPAPGPPPP           25
HCN3       ------------------------------------------------------
HCN4       ---------------------MDKLPPSMRKRLYSLPQQVGAKAWIMDEEE     30
CatSper1   ------------------------------------------------------
CatSper2   ------------------------------------------------------
CatSper3   ------------------------------------------------------
CatSper4   ------------------------------------------------------
Hv1        ------------------------------------------------------
KCa1.1     ------------------------------------------------------
KCa4.1     AGDGAL---------------------LDTAGPKMSDLDSEVLPLPPRYRFR------  71
KCa4.2     ------------------------------MVDLESEVPPLPPRYRFR------  18
TPC1       ------------------------------------------------------

Shaker     ------------------------------------------------------
Nav1.1     FTRESLAAIERRIAEEKAKNPKPDKKD-----DDENGPKPN-----SDLEAGKNLPFIYG  66
Nav1.2     FTRESLAAIEQRIAEEKAKRPKQERKDE----DDENGPKPN-----SDLEAGKSLPFIYG  67
Nav1.3     FTRESLAAIEKRAAEEKAKKPKKEQDN-----DDENKPKPN-----SDLEAGKNLPFIYG  66
Nav1.4     FTRESLAAIEQRAVEEEARLQRNKQMEIEEPERKPRS---------DLEAGKNLPMIYG  69
Nav1.5     FTRESLAAIEKRMAEKQAR--GSTTL----QESREGLPEEEAPRPQLDLQASKKLPDLYG  69
Nav1.6     FTPESLANIERRIAESKLKKPPKADGS-----HREDDEDSKP-KPNSDLEAGKSLPFIYG  70
Nav1.7     FTKQSLALIEQRIAERKSKEPKEEEKD-----DDEEAPKPS-----SDLEAGKQLPFIYG  64
Nav1.8     FTPESLVEIEKQIAAKQGTKKAREKH------REQKDQEEKP-RPQLDLKACNQLPKFYG  68
Nav1.9     FTSDSLAAIEKRIAIQKEKKKSKDQTGE----VPQPRPQL-------DLKASRKLPKLYG  67
Cav1.1     -------------------------------------MEPSSPQDEGLR----------  12
Cav1.2     PGA-----------------------ALSWQAAIDAARQAKLMGSAGNATISTVSSTQR  52
Cav1.3     EANYARGTRLPLSGEGPTSQPNSSKQTVLSWQAAIDAARQAKAAQTMSTSAPPPVGSLSQ  82
Cav1.4     GAG-----------------------PGPEWGLCPGPPAVEGESSGAS----GLGTPK  49
Cav2.1     VVVGSGGG-------------PGAGGSRQGGQPGAQRM-YKQSMAQRARTM--------  59
Cav2.2     GGGA-----------------GGAGGPGPGGLQPGQRVLYKQSIAQRARTM--------  56
Cav2.3     DQSR-----------------NRQGTPVPASGQAAAYKQTKAQRARTM--------    50
Cav3.1     TLGMFRPCEDIACDSQRCRILQAFDDFIFAFFAVEMVVKMVALGIFGKKCYLGDTWNRLD  156
Cav3.2     TLGMFRPCEDVECGSERCNILEAFDAFIFAFFAVEMVIKMVALGLFGQKCYLGDTWNRLD  175
Cav3.3     TLGMYQPCDDMDCLSDRCKILQVFDDFIFIFFAMEMVLKMVALGIFGKKCYLGDTWNRLD  154
Kv1.1      ------------------------------------------------------
Kv1.2      ------------------------------------------------------
Kv1.3      ------------------------------------------------------
Kv1.4      ------------------------------------------------------
Kv1.5      ------------------------------------------------------
Kv1.6      ------------------------------------------------------
Kv1.7      ------------------------------------------------------
Kv1.8      ------------------------------------------------------
Kv2.1      ------------------------------------------------------
Kv2.2      ------------------------------------------------------
Kv3.1      ------------------------------------------------------
Kv3.2      ------------------------------------------------------
Kv3.3      ------------------------------------------------------
```

Figure 15C

```
Kv3.4       ------------------------------------------------------------
Kv4.1       ------------------------------------------------------------
Kv4.2       ------------------------------------------------------------
Kv4.3       ------------------------------------------------------------
Kv5.1       ------------------------------------------------------------
Kv6.1       ------------------------------------------------------------
Kv6.2       ------------------------------------------------------------
Kv6.3       ------------------------------------------------------------
Kv6.4       ------------------------------------------------------------
Kv7.1       ------------------------------------------------------------
Kv7.2       ---------------------------------------------------------MV  2
Kv7.3       ---------------------------------------------------------MG  2
Kv7.4       ---------------------------------------------------MAEAPPRR  8
Kv7.5       ---------------------------------------------------MPRHHAGG  8
Kv8.1       ------------------------------------------------------------
Kv8.2       ------------------------------------------------------------
Kv9.1       ------------------------------------------------------------
Kv9.2       ------------------------------------------------------------
Kv9.3       ------------------------------------------------------------
Kv10.1      ------------------------MTMAGGRRGLVAPQNTFLENIVRR--SNDTN  29
Kv10.2      ------------------------MPGGKRGLVAPQNTFLENIVRR--SSESS  27
Kv11.1      -------------------------MPVRRGHVAPQNTFLDTIIRKFEGQSRK  28
Kv11.2      -------------------------MPVRRGHVAPQNTYLDTIIRKFEGQSRK  28
Kv11.3      -------------------------MPVRRGHVAPQNTFLGTIIRKFEGQNKK  28
Kv12.1      -------------------------MPVMKGLLAPQNTFLDTIATRFDGTHSN  28
Kv12.2      -------------------------MPAMRGLLAPQNTFLDTIATRFDGTHSN  28
Kv12.3      -------------------------MPVMKGLLAPQNTFLDTIATRFDGTHSN  28
HCN1        ------------------------------SSNSRDDGNSVFPAKAS  26
HCN2        PPPAPPQQQPPPPPPPPAPPPGPGPAPPQHPPRAEALPPEAADEGGPRGRLRSRDSSCGRP  85
HCN3        ----------------------------------------------------------ME  2
HCN4        D--------------AEEEGAGGRQDPSRRSIRLRPLPSPSPSAAAGGTESRSSALGAA  75
CatSper1    ------------------------------------------------------------
CatSper2    ------------------------------------------------------------
CatSper3    ------------------------------------------------------------
CatSper4    ------------------------------------------------------------
Hv1         ------------------------------------------------------------
KCa1.1      -----------------------------MANGGGGGGGSSGGGGGGGGSSLRMSS  27
KCa4.1      ---------DLLLGDPS---------------FQNDDRVQVE----FYVNENTFKERLK  102
KCa4.2      ---------DLLLGDQG---------------WQNDDRVQVE----FYMNENTFKERLK  49
TPC1        ---------------------------------------------------MESCYIA  7

Shaker      ------------MAAVAGLYGLGEDRQHRKKQQQQQQHQKEQLEQKE-----------  35
Nav1.1      DIPPEMVSEPLEDLDPYYINKKTFIVLRKGKAIFRFSATSALYILTPFNPLRKIAIKILV  126
Nav1.2      DIPPEMVSVPLEDLDPYYINKKTFIVLRKGKAISRFSATPALYILTPFNPIRKLAIKILV  127
Nav1.3      DIPPEMVSEPLEDLDPYYINKKTFIVMNKGKAIFRFSATSALYILTPLNPVRKIAIKILV  126
Nav1.4      DPPPEVIGIPLEDLDPYYSNKKTFIVLRKGKAIFRFSATPALYLLSPFSVVRRGAIKVLI  129
Nav1.5      NPPQELIGEPLEDLDPFYSTQKTFIVLRKGKTIFRFSATNALYVLSPFHPIRRAAVKILV  129
Nav1.6      DIPQGLVAVPLEDFDPYYLTQKTFVVLNRGKTLFRFSATPALYILSPFNLIRRIAIKILI  130
Nav1.7      DIPPGMVSEPLEDLDPYYADKKTFIVLRKGKTIFRFNATPALYMLSPFSPLRRISIKILV  124
Nav1.8      ELPAELIGEPLEDLDPFYSTHRTEMVLNKGRTISRFSATRALWLFSPFNLIRRTAIKVSV  128
Nav1.9      DIPRELIGKPLEDLDPFYRNHKTFMVLNRRKPTIYRFSAKHALFIFGPFNSIRSLAIRVSV  127
Cav1.1      -----KKQPKKPVPEILPRPPRALFCLTLENPLRKACISIVEWKPFETIILLTIFANCVA  67
Cav1.2      KRRQ-YGKPKKQGSTTATRPPRALLCLTLKNPIRRACISIVEWKPFEIIILLTIFANCVA  111
Cav1.3      RKRQQYAKSKKQGNSSNSRPARALFCLSLNNPIRRACISIVEWKPFDIFILLAIFANCVA  142
Cav1.4      RRNQ-HSKHKTVAVASAQRSPRALFCLTLANPLRRSCISIVEWKPFDILILLTIFANCVA  108
Cav2.1      ---ALYNPIPVRQNCLTVNRSLFLFSEDNVVRKYAK----KITEWPPFEYMILATIIANCIV  114
Cav2.2      ---ALYNPIPVKQNCFTVNRSLFVFSEDNVVRKYAK----RITEWPPFEYMILATIIANCIV  111
Cav2.3      ---ALYNPIPVRQNCFTVNRSLFIFGEDNIVRKYAK----KLIDWPPFEYMILATIIANCIV  105
```

Figure 15D

```
Cav3.1      FFIVIAGMLEYSLDLQNVSFSAVRT--VRVLRPLRAINRVPSMRILVTLLDTLPMLGNV 214
Cav3.2      FFIVVAGMMEYSLDGHNVSLSAIRT--VRVLRPLRAINRVPSMRILVTLLDTLPMLGNV 233
Cav3.3      FFIVMAGMVEYSLDLQNINLSAIRT--VRVLRPLKAINRVPSMRILVNLLDTLPMLGNV 212
Kv1.1       ------------------------M-TVMS----------------------------   5
Kv1.2       ------------------------M-TVAT----------------------------   5
Kv1.3       ----------MDERLSLLRSPPPSAR-HRAHPPQRPAS--------------------  28
Kv1.4       ---MEVAMVSAESSGCNSHMPYGYAAQARAREPERLAH--------------------  35
Kv1.5       ----MEIALVPLENGGAMTVRGGDEARAGCGQATGGELQ-------------------  35
Kv1.6       ---------------MRSEKSLTLAAPGEV----------------------------  15
Kv1.7       -------------------MEPRC----------------------------------   5
Kv1.8       -----------MDVCGWKEMEVALVNPDNSDEIQEEP---------------------  26
Kv2.1       ---------------MPAGMTKHGSRSTSSLPPEP-----------------------  20
Kv2.2       -----------MAEKAPPGLNRKTSRSTLSLPPEP-----------------------  24
Kv3.1       ----------------------------------------------------------
Kv3.2       ----------------MGKIENNERVILNVGGTRHETY-------------------  22
Kv3.3       -------------MLSSVCVSSFRGRQGASKQQPAPPPQPPESPPPPPLPPQQQQPAQPG 47
Kv3.4       --------------MISSVCVSSYRGRKSGNKPPSKTCL-------------------  25
Kv4.1       ---------------MAAGLATWLPF-------------------------------  11
Kv4.2       ---------------MAAGVAAWLPF-------------------------------  11
Kv4.3       ---------------MAAGVAAWLPF-------------------------------  11
Kv5.1       -----------MDGSGERSLPEPGSQSSAASDDIEI----------------------  25
Kv6.1       ----------MTLLPGDNSDY-DYSALSCTSDASF-----------------------  24
Kv6.2       --------MEPWPCSPGGGGGTRAPHVIIN----------------------------  22
Kv6.3       --------------MTFGRSGAASVVLNVGG---------------------------  17
Kv6.4       ----------MPMPSRDGGLHPRHHHYGSHSPWSQL----------------------  26
Kv7.1       ---MAAASSPPRAERKRWGWGRLPGARRGSAGLAKKCPFSLELAE-------------  42
Kv7.2       QK-SRNGGVYPGPS-GEKKLKVGFVGLDPGAPDSTRDGALLIAG----------SEAPKR 50
Kv7.3       LKARRAAGAAGGGG-DGGGGGGGAANPAGGDAA--AAGDEERKV----------GLAPGD 49
Kv7.4       LGLGPPPGDAPRAELVALTAVQSEQGEAGGGGS--PRRLGLLGS----------PLPPGA 56
Kv7.5       EEGGAAGLWVKSGAAAAAAGGGRLGSGMKDVES--GRGRVLLNS----------AAARGD 56
Kv8.1       -----MPSSGRALLDSPLDSGSLTSLDSSVFCSEGE----------------------  31
Kv8.2       -----MLKQSERRRSWSYRPWNTTENEGSQHRRSICSL--------------------  33
Kv9.1       ----------MLMLLVRGTHYENLRSKVVLPTPLGG----------------------  26
Kv9.2       ------------------------MTGQ------------------------------   4
Kv9.3       ------------------------MTRQ------------------------------   4
Kv10.1      FVLGNAQIVDWPI-VYSNDGFCKLSGYHRAEVMQKSSTCSFMYG---------ELTDKD  78
Kv10.2      FLLGNAQIVDWPV-VYSNDGFCKLSGYHRADVMQKSSTCSFMYG---------ELTDKK  76
Kv11.1      FIIANA-RVENCAVIYCNDGFCELCGYSRAEVMQRPCTCDFLHG---------PPTQPR  77
Kv11.2      FLIANA-QMENCAIIYCNDGFCELFGYSRVEVMQQPCTCDFLTG---------PNTPSS  77
Kv11.3      FIIANA-RVQNCAIIYCNDGFCEMTGFSRPDVMQKPCTCDFLHG---------PETKRH  77
Kv12.1      FILANAVAKGFPIVYCSDGFCELAGFARTEVMQRGCSCCKFLFG---------VETNEQ  78
Kv12.2      FVLGNAQVAGLFPVVYCSDGFCDLTGFSRAEVMQRGCACSFLYG---------PDTSEL  78
Kv12.3      FLLANAQGTRGFPIVYCSDGFCELTGYGRTEVMQKTCSCRFLYG---------PETSEP  78
HCN1        ATGAGPAAAEKRLG-TPPGGGGAGAKEHGNSVCFKVDGGGGGGG---------GGGGGE  75
HCN2        GTPGAASTAKGSPN-GECGRGEPQCSPAGPEGPARGPKVSFSCR---------GAASGP 134
HCN3        AEQRPAAGASEG----ATPGLEA--VPPVAPPPATAASGPIPKS---------GPEPK-  45
HCN4        DSEGPARGAGKSST-NGDCRRFR--GSLASLGSRGGGSGGTGSG---------SSHGHL 122
CatSper1    --MDQNSVPEKAQNEADTMNNADRFFRSHSSPPHHRP---------------------  34
CatSper2    --MAAYQQEEQMQLPRADAIRSRLIDTFSLIEHLQGL---------------------  35
CatSper3    -------MSQHRHQRHSRVISSSPVDTTSVGFCPTFKKFK------------------  33
CatSper4    ----------------------------------------------------------
Hv1         ----------------------------------------------------------
KCa1.1      NIHANHLSLDASSSSSSSSSSSSSSSSSSSSSVHEPKMDALIIP--------------  72
KCa4.1      LFFIKNQRSSLRIRLFNFSLKLLTCLLYIVRVLLDDPALGIGCW--GCPKQNYSFNDSSS 160
KCa4.2      LFFIKNQRSSLRIRLFNFSLKLLSCLLYIIRVLLENP-----SQ--GNEW-SHIFWVNRS 101
TPC1        QAGLELLGSSSSPTLTSQSAEITEDASNGGVSEQHPWPSGFEREL-------------  52

Shaker      ----------------------------------------------------------
Nav1.1      HSLFSMLIMCTILTNCVFMT---MSNPPDWTKN------------------------ 156
Nav1.2      HSLFNMLIMCTILTNCVFMT----MSNPPDWTKN----------------------- 157
Nav1.3      HSLFSMLIMCTILTNCVFMT---LSNPPDWTKN------------------------ 156
Nav1.4      HALFSMFIMITILTNCVFMT---MSDPPPWSKN------------------------ 159
```

Figure 15E

```
Nav1.5      HSLFNMLIMCTILTNCVFMA---QHDPPPWTKY--------------------------- 159
Nav1.6      HSVFSMIIMCTILTNCVFMT---FSNPPDWSKN--------------------------- 160
Nav1.7      HSLFSMLIMCTILTNCIFMT---MNNPPDWTKN--------------------------- 154
Nav1.8      HSWFSLFITVTILVNCVCMT---RTDLPEKIEY--------------------------- 158
Nav1.9      HSLFSMFIIGTVIINCVFMATGPAKNSNSNNTDI-------------------------- 161
Cav1.1      LAVYLPMPEDDNNSLNLGLEKLEYFFLIVFSIEA-------------------------- 101
Cav1.2      LAIYIPFPEDDSNATNSNLERVEYLFLIIFTVEA-------------------------- 145
Cav1.3      LAIYIPFPEDDSNSTNHNLEKVEYAFLIIFTVET-------------------------- 176
Cav1.4      LGVYIPFPEDDSNTANHNLEQVEYVFLVIFTVET-------------------------- 142
Cav2.1      LALEQHLPDDDKTPMSERLDDTEPYFIGIFCFEA-------------------------- 148
Cav2.2      LALEQHLPDGDKTPMSERLDDTEPYFIGIFCFEA-------------------------- 145
Cav2.3      LALEQHLPEDDKTPMSRRLEKTEPYFIGIFCFEA-------------------------- 139
Cav3.1      LLLCFFVFFIFGIVGVQLWAGLLRNRCFLPENFSLPLSVDL------------------- 255
Cav3.2      LLLCFFVFFIFGIVGVQLWAGLLRNRCFLDSAFV--RNNNLTFL---------------- 275
Cav3.3      LLLCFFVFFIFGIIGVQLWAGLLRNRCFLEENFTIQGDVAL------------------- 253
Kv1.1       ------------------------------------------------------------
Kv1.2       ------------------------------------------------------------
Kv1.3       ------------------------------------------------------------
Kv1.4       ------------------------------------------------------------
Kv1.5       ------------------------------------------------------------
Kv1.6       ------------------------------------------------------------
Kv1.7       ------------------------------------------------------------
Kv1.8       ------------------------------------------------------------
Kv2.1       ------------------------------------------------------------
Kv2.2       ------------------------------------------------------------
Kv3.1       ------------------------------------------------------------
Kv3.2       ------------------------------------------------------------
Kv3.3       PAASPAGPPAPRGPGDRRAE---------------------------------------- 67
Kv3.4       ------------------------------------------------------------
Kv4.1       ------------------------------------------------------------
Kv4.2       ------------------------------------------------------------
Kv4.3       ------------------------------------------------------------
Kv5.1       ------------------------------------------------------------
Kv6.1       ------------------------------------------------------------
Kv6.2       ------------------------------------------------------------
Kv6.3       ------------------------------------------------------------
Kv6.4       ------------------------------------------------------------
Kv7.1       ------------------------------------------------------------
Kv7.2       GSIL-------------------------------------------------------- 54
Kv7.3       VEQ--------------------------------------------------------- 52
Kv7.4       PLP--------------------------------------------------------- 59
Kv7.5       GLLLL------------------------------------------------------- 61
Kv8.1       ------------------------------------------------------------
Kv8.2       ------------------------------------------------------------
Kv9.1       ------------------------------------------------------------
Kv9.2       ------------------------------------------------------------
Kv9.3       ------------------------------------------------------------
Kv10.1      TIE-------------KVRQ---------------------------------------- 85
Kv10.2      TIE-------------KVRQ---------------------------------------- 83
Kv11.1      AAAQIAQALLGAEERKVEIAFYRKDGSCFLCLVDVVPVKNEDGAVIMFILNFEVVMEKDM 137
Kv11.2      A----------VSRLAQ------------------------------------------- 84
Kv11.3      DIAQIAQALLGSEERKVEVTYYHKNGSTFICNTHIIPVKNQEGVAMMFIINFEYVTDNEN 137
Kv12.1      L----------MLQIEKS------------------------------------------ 86
Kv12.2      -----------VRQQIRK------------------------------------------ 85
Kv12.3      -----------ALQRLHK------------------------------------------ 85
HCN1        EP---------------------------------------------------------- 77
HCN2        APGP-------------------------------------------------------- 138
HCN3        ------------------------------------------------------------
HCN4        HDSAEERRLIAEGDASPGEDRTPPGLAAEPERPGASAQPA-------------------- 162
CatSper1    ------------------------------------------------------------
CatSper2    ------------------------------------------------------------
CatSper3    ------------------------------------------------------------
CatSper4    ------------------------------------------------------------
```

Figure 15F

```
Hv1        ------------------------------------------------
KCa1.1     ------------------------------------------------
KCa4.1     EINW--APILWVERKMTLWAIQVIVAII------------------   186
KCa4.2     LPL-------WGLQVS--------VALI------------------   114
TPC1       ------------------------------------------------

Shaker     ----------------------------------EQKKIAERKLQLREQQLQ--   53
Nav1.1     --------------------------VEYTFTGIYTFESLIKIIARGFCLEDFTFLRD--   188
Nav1.2     --------------------------VEYTFTGIYTFESLIKILARGFCLEDFTFLRD--   189
Nav1.3     --------------------------VEYTFTGIYTFESLIKILARGFCLEDFTFLRD--   188
Nav1.4     --------------------------VEYTFTGIYTFESLIKILARGFCVDDFTFLRD--   191
Nav1.5     --------------------------VEYTFTAIYTFESLVKILARGFCLHAFTFLRD--   191
Nav1.6     --------------------------VEYTFTGIYTFESLVKIIARGFCIDGFTFLRD--   192
Nav1.7     --------------------------VEYTFTGIYTFESLVKILARGFCVGEFTFLRD--   186
Nav1.8     --------------------------VF---TVIYTFEALIKILARGFCLNEFTYLRD--   187
Nav1.9     --------------------------AECVFTGIYIFEALIKILARGFILDEFSFLRD--   193
Cav1.1     -------------------------AMKIIAYGFLFHQDAYLRSGWNVLDFTIVFLGV    134
Cav1.2     -------------------------FLKVIAYGLLFHPNAYLRNGWNLLDFIIVVVGL    178
Cav1.3     -------------------------FLKIIAYGLLLHPNAYVRNGWNLLDFVIVIVGL    209
Cav1.4     -------------------------VLKIVAYGLVLHPSAYIRNGWNLLDFIIVVVGL    175
Cav2.1     -------------------------GIKIIALGFAFHKGSYLRNGWN-------VMDF    174
Cav2.2     -------------------------GIKIIALGFVFHKGSYLRNGWN-------VMDF    171
Cav2.3     -------------------------GIKIVALGFIFHKGSYLRNGWN-------VMDF    165
Cav3.1     ----------------ERYYQTENEDESPFICSQPRENGMRSCRSVPTLRGDGGGG    295
Cav3.2     ----------------RPYYQTEEGEENPFICSS---RRDNGMQKCSHIPGRRELR    312
Cav3.3     ----------------PPYYQPEEDDEMPFICSL---SGDNGIMGCHEIPPLKEQG    290
Kv1.1      --------------------------------GENVDEAS---A---------   14
Kv1.2      --------------------------------GDPADEAA---A---------   14
Kv1.3      --------------------------------SGGAHTLVN---HGYAEP--   43
Kv1.4      --------------------------------SRAAAAAAV---AAATAA--   50
Kv1.5      --------------------------------CPFTAGLSD---GPKEPA--   50
Kv1.6      ----------------------------------RG---PEGEQQ--   23
Kv1.7      ------------------------------------------------
Kv1.8      ----------------------------GYATDFDS---TSPKGR--   40
Kv2.1      --------------------------------------MEI---   23
Kv2.2      --------------------------------------VDI---   27
Kv3.1      ------------------------------MGQGDESERIVIN----   13
Kv3.2      ------------------------------RSTLKTLPGTRLAL---   36
Kv3.3      ------------------PCFGLPAAAMGRHGGGGGDSGKIVIN----   93
Kv3.4      --------------------------KEEMAKGEASEKIIIN----   41
Kv4.1      -------------------------------------ARA---   14
Kv4.2      -------------------------------------ARA---   14
Kv4.3      -------------------------------------ARA---   14
Kv5.1      ------------------------------------------------
Kv6.1      -----------------------------HPAFLPQRQAIKGAF---   39
Kv6.2      ---------------------------------------VGG---   25
Kv6.3      ----------------------------ARYSLSRELLKDFPL    32
Kv6.4      ----------------------------LSSPMETPSIKGLYYRP--   43
Kv7.1      ----------------------------GGPAGGALYAFIAPGAPGPA   62
Kv7.2      ---------------------------SKPR---AGGAGAGKPP---------   68
Kv7.3      ----------------------------VTLALGAGADKDGTLLLEGGGRD   75
Kv7.4      ------------------------------------GPGSGGGSACGQRS---   73
Kv7.5      ---------------------------GTRAATLGGGGGGLRESRRGKQG   84
Kv8.1      --------------------------------GEPLALGDCFTVN---   44
Kv8.2      ------------------------------------------------
Kv9.1      ----------------------------RSTETFVSEFPGPDTGI---   43
Kv9.2      --------------------------------------SLWDVS---   10
Kv9.3      --------------------------------------SLWDLS---   10
Kv10.1     ----------------------------TFENYEMNSFEILMYK----   101
Kv10.2     ----------------------------TFDNYESNCFEVLLYK----   99
Kv11.1     VGSPAHD-------TNHRGFPTSWLAPGRAKTFRLKLPALLALTARESSVRSGGAGGAGA   190
Kv11.2     -------------------------------ALLGAEECKVDILYYR----   100
Kv11.3     AATPERVNPILPIKTVNRKFFGFKFPGLRVLTYRKQSLPQEDPDVVIDSSKHSDDS---   194
```

Figure 15G

```
Kv12.1    ------------------------------------------LEEKTEFKGEI-MFYK---  101
Kv12.2    ------------------------------------------ALDEHKEFKAELILYR---  101
Kv12.3    ------------------------------------------ALEGHQEHRAEICFYR---  101
HCN1      --------------------------------------AGGFEDAEGPRRQYGFMQ--   95
HCN2      ---------------------------------GPAEEAGSEEAGPAGEPRGSQA---  160
HCN3      ----------------------------------------RRHLGTLLQPTV---   57
HCN4      ------------ASPPPPQQFPQPASASCEQPSVDTAIKVEGGAAAGDQILPEAEVR  207
CatSper1  ---------------------------------------------------------
CatSper2  ------------------------------------SQAVPRHTIRELLDPSRQ-   53
CatSper3  ---------------------------------------------------------
CatSper4  ---------------------------------------------------------
Hv1       ---------------------------------------------------------
KCa1.1    ---------------------------------VTMEVPCDSRGQRMWWAFL  91
KCa4.1    ---------------------------SFLETML---LIYLSYKGNIWEQIFPVSF  212
KCa4.2    ---------------------------SLFETIL---LGYLSYKGNIWEQILRPIPF  140
TPC1      ---------------------------------------KPETISSPGYHILRATGEE-  71

Shaker    -------------------------RNSLDGYGSLP------------------KLSSQDE   71
Nav1.1    -------------------------PWNWLDFTVITFA--YVTEFVDLGNVSALRTFRVLRA  223
Nav1.2    -------------------------PWNWLDFTVITFA--YVTEFVDLGNVSALRTFRVLRA  224
Nav1.3    -------------------------PWNWLDFSVIVMA--YVTEFVSLGNVSALRTFRVLRA  223
Nav1.4    -------------------------PWNWLDFSVIMMA--YLTEFVDLGNISALRTFRVLRA  226
Nav1.5    -------------------------PWNWLDFSVIIMA--YTTEFVDLGNVSALRTFRVLRA  226
Nav1.6    -------------------------PWNWLDFSVIMMA--YITEFVNLGNVSALRTFRVLRA  227
Nav1.7    -------------------------PWNWLDFVVIVFA--YLTEFVNLGNVSALRTFRVLRA  221
Nav1.8    -------------------------PWNWLDFSVITLA--YVGTAIDLRGISGLRTFRVLRA  222
Nav1.9    -------------------------PWNWLDSIVIGIAI-VSYIPGITIKLLPLRTFRVPRA  229
Cav1.1    FTVILEQVNVIQ-SHTAP----MSSKGAGLDVK---------ALRAFRVLRP  172
Cav1.2    FSAILEQATKAD-GANA-----LGGKGAGFDVK---------ALRAFRVLRP  215
Cav1.3    FSVILEQLTKETEGGNH-----SSGKSGGFDVK---------ALRAFRVLRP  247
Cav1.4    FSVLLEQGPGRPGDAPH-----TGGKPGGFDVK---------ALRAFRVLRP  213
Cav2.1    VVV----LTGIL--ATV-------GTEFDLR----------TLRAVRVLRP  202
Cav2.2    VVV----LTGIL--ATA-------GTDFDLR----------TLRAVRVLRP  199
Cav2.3    IVV----LSGIL--ATA-------GTHFNTHVDLR------TLRAVRVLRP  197
Cav3.1    PPCGLDYEAYN----------SSS---NTTCV---------NWNQYYTN  322
Cav3.2    MPCTLGWEAYT-------QPQAEGVG-AARNACI-------NWNQYYNV  346
Cav3.3    RECCLSKDDVY-------DFGAGRQDLNASGLCV-------NWNRYYNV  325
Kv1.1     ----------------APGHPQ----------------DGSYPRQ   27
Kv1.2     ----------------LPGHPQ----------------DTYDPE-   26
Kv1.3     ----------------AAGRELPPD-------------MTVVPGD   59
Kv1.4     ----------------VEGSGGGSGGG-----------SHHHHQSR   68
Kv1.5     ----------------PKGRGAQRDA------------DSGVRPLP   68
Kv1.6     ----------------DAGDFPEAGG------------GGGCC---   38
Kv1.7     ----------------------------------------PPPCG---   10
Kv1.8     ----------------PGGSSFSNGKIL----------ISESTNHETA   62
Kv2.1     ----------------VRSKACSRPVR-----------LNVGGLA-   41
Kv2.2     ----------------IRSKTCSRRVK-----------INVGGLN-   45
Kv3.1     ----------------VGG---TRHQ------------TYRSTL-   26
Kv3.2     ----------------LASSEPPGDCL-----------TTAGDKL   54
Kv3.3     ----------------VGG---VRHE------------TYRSTL-  106
Kv3.4     ----------------VGG---TRHE------------TYRSTL-   54
Kv4.1     ----------------AAVGWLPLAQ------------QPLPPAPGVKASRG-   38
Kv4.2     ----------------AAIGWMPVASGP----------MPAPPRQERKRTQD-   40
Kv4.3     ----------------AAIGWMPVAN------------CPMPLAPADKNKRQ-   38
Kv5.1     ----------------VVNVGGVRQVL-----------YGDLLSQ   43
Kv6.1     ----------------YRRAQRLRPQDEP--RQGCQPEDRRPRIIINVGGIKY   74
Kv6.2     ----------------CRVRLA----------------WAALARC   38
Kv6.3     ----------------RRVSRLH---------------GCRSERD   46
Kv6.4     ----------------VRKVGALDA------SPV----DLKKEILINVGGRRY   70
Kv7.1     PP--------------ASPAAPAAPP------------VASDLGP   81
Kv7.2     ----------------KRNAFYRKLQNF----------LYNVLERP   88
Kv7.3     EGQRRTPQGIGLLAKTPLSRPVKRNNAKYRRIQTL---IYDALERP  118
Kv7.4     ----------------SAAHKRYRRLQNW---------VYNVLERP   94
```

Figure 15H

```
Kv7.5       ARMSLLGKPLS-----YTSSQSCRRNVKYRRVQNY-----------------LYNVLERP 122
Kv8.1       ------------------------VGGSRFVLSQQ------------------ALSCFPH  62
Kv8.2       ------------------------GARSGSQASIHGW----------------TEGNYNYYIE 56
Kv9.1       ------------------------RWRRSDEALRV------------------NVGGVRR  61
Kv9.2       ------------------------EANVEDGEIRI------------------NVGGFKR  28
Kv9.3       ------------------------ETDVEDGEIRI------------------NVGGFKR  28
Kv10.1      ------------------------KNRTPVWFF--------------------VKIAPIRN 118
Kv10.2      ------------------------KNRTPVWFY--------------------MQIAPIRN 116
Kv11.1      P-----------------------GAVVVDVDLTPAAPSSESLALDE------VTAMDNHV 222
Kv11.2      ------------------------KDASSFRCL--------------------VDVVPVKN 117
Kv11.3      ------------------------VAMKHFKSPTKESCSPSEADDTKALIQPSKCSPLVN 230
Kv12.1      ------------------------KNGSPFWCL--------------------LDIVPIKN 118
Kv12.2      ------------------------KSGLPFWCL--------------------LDVIPIKN 118
Kv12.3      ------------------------KDGSAFWCL--------------------LDMMPIKN 118
HCN1        -------------RQFTSMLQPGVNKFSLRMFGS--------------------QKAVEKEQ 124
HCN2        ---------SFMQRQFGALLQPGVNKFSLRMFGS--------------------QKAVEREQ 193
HCN3        ------------------NKFSLRVFGS--------------------HKAVEIEQ  75
HCN4        LGQA------GFMQRQFGAMLQPGVNKFSLRMFGS-------------------QKAVEREQ 244
CatSper1    -------------------------GHSRALHHYEL-----------------HHHGVPHQ  53
CatSper2    -------------------------KKLVLGDQHQL-----------------VRFSIKP  71
CatSper3    -------------------------RNDDECRAF-------------------VKRVIMS  49
CatSper4    -------------------------MRDNEKAWWQQ-----------------WTSHTGL  18
Hv1         -------------------------MATWDEKAV-------------------TRRA---  13
KCa1.1      A------------------------SSMVTFFGGLFIIL--------LWRTLKYLWTVCCHC 121
KCa4.1      VLEMINTLPFII--------TIFWPPLR---NLFIP-----------------VFLNCWLA 245
KCa4.2      ILELINAVPFII--------SIFWPSLR---NLFVP-----------------VFLNCWLA 173
TPC1        -------------------------NMAVSLDDDVPLI----------LTLDEGGSAPLAP  97

Shaker      EGGAGH----GFGGGPQHFEPIP--------------------------------  90
Nav1.1      LKTISVIPGLKTIVGALIQSVKKLSDVMILTVFCLSVFALIGLQLFMGNLRNKCIQWPPT 283
Nav1.2      LKTISVIPGLKTIVGALIQSVKKLSDVMILTVFCLSVFALIGLQLFMGNLRNKCLQWPP- 283
Nav1.3      LKTISVIPGLKTIVGALIQSVKKLSDVMILTVFCLSVFALIGLQLFMGNLRNKCLQWPP- 282
Nav1.4      LKTITVIPGLKTIVGALIQSVKKLSDVMILTVFCLSVFALVGLQLFMGNLRQKC------ 280
Nav1.5      LKTISVISGLKTIVGALIQSVKKLADVMVLTVFCLSVFALIGLQLFMGNLRHKC------ 280
Nav1.6      LKTISVIPGLKTIVGALIQSVKKLSDVMILTVFCLSVFALIGLQLFMGNLRNKC------ 281
Nav1.7      LKTISVIPGLKTIVGALIQSVKKLSDVMILTVFCLSVFALIGLQLFMGNLKHKCF----- 276
Nav1.8      LKTVSVIPGLKVIVGALIHSVKKLADVTILTIFCLSVFALVGLQLFKGNLKNKC------ 276
Nav1.9      LKAISVVSRLKVIVGALLRSVKKLVNVIILTFFCLSIFALVGQQLFMGSLNLKCI----- 284
Cav1.1      LRLVSGVPSLQVVLNSIFKAMLPLFHIALLVLFMVIIYAIIGLELFKGKMHKTCYFIGTD 232
Cav1.2      LRLVSGVPSLQVVLNSIIKAMVPLLHIALLVLFVIIIYAIIGLELFMGKMHKTCY-NQEG 274
Cav1.3      LRLVSGVPSLQVVLNSIIKAMVPLLHIALLVLFVIIIYAIIGLELFIGKMHKTCFFADSD 307
Cav1.4      LRLVSGVPSLHIVLNSIMKALVPLLHIALLVLFVIIIYAIIGLELFLGPMHKTCYFLGSD 273
Cav2.1      LKLVSGIPSLQVVLKSIMKAMIPLLQIGLLLFFAILIFAIIGLEFYMGKFHTTCF--EEG 260
Cav2.2      LKLVSGIPSLQVVLKSIMKAMVPLLQIGLLLFFAILMFAIIGLEFYMGKFHKACF--PNS 257
Cav2.3      LKLVSGIPSLQIVLKSIMKAMVPLLQIGLLLFFAILMFAIIGLEFYSGKLHPACF--MNN 255
Cav3.1      CSAGEHNPFKGAINFDNIGYAWIAIFQVITLE--GWVDIMYFVMDA-HSFYNFIYFILLI 379
Cav3.2      CRSGDSNPHNGAINFDNIGYAWIAIFQVITLE--GWVDIMYYVMDA-HSFYNFIYFILLI 403
Cav3.3      CRTGSANPHKGAINFDNIGYAWIVIFQVITLE--GWVEIMYYVMDA-HSFYNFIYFILLI 382
Kv1.1       A---------DHDD---------------------------------------  32
Kv1.2       -----------AD----------------------------------------  23
Kv1.3       HLLEPE----VADGGGAPPQGGCGGGGCDRYEPLPPSLPAA-------------  96
Kv1.4       GACTSHDPQSSRGSRRRRQPSEKKKAHYRQSSFPHCSDLMPSGSEEKILRELSEEEEDE 128
Kv1.5       PLPDPG------VRPLPPLPEELPRPRKPPPEDEEEEGDPGLGTVE-------- 108
Kv1.6       -----------------------------------------------------
Kv1.7       -----------------------------------------------------
Kv1.8       FSKLPG----DYADPPGPEP---------------------------------  78
Kv2.1       -----------------------------------------------------
Kv2.2       -----------------------------------------------------
Kv3.1       ------------RTLPGTRLA------WLAEPDA-------------------  42
Kv3.2       QPSPPPLSPPPRAPPLSPGPGGCFEGGAGNCSSR-------------------  83
Kv3.3       ------------RTLPGTRLA------GLTEPEA-------------------  122
Kv3.4       ------------RTLPGTRLAWL----ADPDGGGRPET---------------  76
Kv4.1       -----------------------------------------------------
```

Figure 15I

```
Kv4.2       ------------------------------------------------------------
Kv4.3       ------------------------------------------------------------
Kv5.1       YPETRLAELINCLAGGY-------------------------------------------  60
Kv6.1       SLPWTTLDEFPLTRLGQLKAC---------------------------------------  95
Kv6.2       PLARLE---------RLRAC----------------------------------------  49
Kv6.3       ------------------------------------------------------------
Kv6.4       LLPWSTLDRFPLSRLSKLRLC---------------------------------------  91
Kv7.1       RPP---------------------------------------------------------  84
Kv7.2       RGWAFI--YHAYVFLLVFSCLVLS---------------VFSTIKEYEKSSEGALYILE-- 130
Kv7.3       RGWALL--YHALVFLIVLGCLILA---------------VLTTFKEYETVSGDWLLLLE-- 160
Kv7.4       RGWAFV--YRVFIFLLVFSCLVLS---------------VLSTIQERQELANECLLILE-- 136
Kv7.5       RGWAFI--YHAFVFLLVFGCLILS---------------VFSTIPEHTKLASSCLLILE-- 164
Kv8.1       TRL---------------------------------------------------------  65
Kv8.2       EDEDGEEEDQWKDDLAEEDQQ---------------------------------------  77
Kv9.1       QLSARALARFPGTRLGRLQAA---------------------------------------  82
Kv9.2       RLRSHTLLRFPETRLGRLLLC---------------------------------------  49
Kv9.3       RLRSHTLLRFPETRLGRLLLC---------------------------------------  49
Kv10.1      EQ-------DKVVLFLCTFS-------------------DITAFKQPIEDD--------- 143
Kv10.2      EH-------EKVVLFLCTFK-------------------DITLFKQPIEDD--------- 141
Kv11.1      AGLGPAEERRALVGPGSPPRSAPGQLPSPRA--HSLNPDASGSSCSLARTRSRESCAS-- 278
Kv11.2      ED-------GAVIMFILNFEDLAQ----LLA---------KCSSRSLSQ----------- 146
Kv11.3      IS-------GPLDHSSPKRQWDRL----YPDMLQSSSQLSHSRSRESLCSIRPASSVHDIE 280
Kv12.1      EK-------GDVVLFLASFKDI-----------------TDTKV-KITPEDK-------- 145
Kv12.2      EK-------GEVALFLVSHKDISE---------------TKNRGGPDRWKETG------- 149
Kv12.3      EM-------GEVVLFLFSFKDI-----------------TQSGSPGLGPQGG-------- 146
HCN1        ERV-----KTAGFWIIHPYSDF-----------------RFYWDLIMLIMMVGNLV---- 158
HCN2        ERV-----KSAGAWIIHPYSDF-----------------RFYWDFTMLLFMVGNLI---- 227
HCN3        ERV-----KSAGAWIIHPYSDF-----------------RFYWDLIMLLLMVGNLI---- 109
HCN4        ERV-----KSAGFWIIHPYSDF-----------------RFYWDLTMLLLMVGNLI---- 278
CatSper1    RGESHHPPEFQDFH----------------------------------------------  67
CatSper2    QRIEQI------------------------------------------------------  77
CatSper3    ------------------------------------------------------------
CatSper4    EGW---------------------------------------------------------  21
Hv1         ------------------------------------------------------------
KCa1.1      GGKTKEAQKINNGSSQADGTLKP------------------------------------- 144
KCa4.1      KHALENMINDFHRAILRTQSAMFNQ---------VLILFCTLLCLVFTGTCGIQHLERAG 296
KCa4.2      KHALENMINDLHRAIQRTQSAMFNQ---------VLILISTLLCLIFTCICGIQHLERIG 224
TPC1        SNGLGQEELPSKNGGSYAIHDSQ------------------------------------- 120

Shaker      ---------------------------------------------------HDHD  94
Nav1.1      NASLEEHSIEKNITVNY--NGTLI---NETVFEFDWK--SYIQD--SK--YHYFLEGFLDALL 335
Nav1.2      DNSSFEINITSFFNNSL--DGNGTTFNRTVSIFNWD--EYIED-KS--HFYFLEGQNDALL 337
Nav1.3      SDSAFETNTTSYFNGTM--DSNGTFVNVTMSTFNWK--DYIGD-DS--HFYVLDGQKDPLL 336
Nav1.4      --------------VRWPPFFNDTNTTWYSNDTWYG-NDT---------WYGNEMW--- 312
Nav1.5      --------------VRNFTALNGTNGSVEADGLVWE-SLDLYLSDPENYLLKNGTSDVLL 325
Nav1.6      --------------VVW--PINFNESYLENG--TKGFDWEEYINN--KTNFYTVPGMLEP 321
Nav1.7      ----------------RNS--LENNETLESIM----NTL--ESEEDFPK--YFYYLEGSKDALL 314
Nav1.8      --------------VKNDMAVNETTNYSSHRKPDIY------------INKRGTSDPL 308
Nav1.9      ---------------SRD-------CKNISNPEAYD---------------HCFEKKENSPEF 310
Cav1.1      IVAT-VENEEPSPCART-----------------GSG--RRCTINGSECRGGC 265
Cav1.2      IADVPAEDDPSPCALET-----------------GHG--RQCQNG-TVCKPGW 307
Cav1.3      IVAEEDPAPCAFS---------------------GNG--RQCTANGTECRSGW 337
Cav1.4      MEAEEDPSPCASS---------------------GSG--RACTLNQTECRGRW 303
Cav2.1      TDDIQGESP--APC--------------------GTEEPARTCPNGTKCQPYW 291
Cav2.2      TDAEPVGDF-P-C---------------------GKEAPARLCEGDTECREYW 287
Cav2.3      SGILEGFDPHPC----------------------G-----VQGCPAGYECK-DW 282
Cav3.1      IVGSFF--------------------------MINLCLVVIATQFSETKQRESQL 408
Cav3.2      IVGSFF--------------------------MINLCLVVIATQFSETKQRESQL 432
Cav3.3      IVGSFF--------------------------MINLCLVVIATQFSETKQREHRL 411
Kv1.1       ---------------------------------------------------HE  34
Kv1.2       ---------------------------------------------------HE  30
Kv1.3       ---------------------------------------------------GEQDC 101
Kv1.4       EEEEEEEEEGRFYYSEDDHGDECSYTDLLPQDEGGG------------GYSSVRYSD 173
```

Figure 15J

```
Kv1.5      --------------------------------------------------DQALGTASL 117
Kv1.6      ----------------------------------------------------------
Kv1.7      ----------------------------------------------------------
Kv1.8      ------------------------------------------------------VVLNE 83
Kv2.1      ----------------------------------------------------------
Kv2.2      ----------------------------------------------------------
Kv3.1      ----------------------------------------------------------H 43
Kv3.2      ----------------------------------------------------------G 89
Kv3.3      ----------------------------------------------------------A 123
Kv3.4      ------------------------------------------------------DGGGV 81
Kv4.1      ----------------------------------------------------------
Kv4.2      ----------------------------------------------------------
Kv4.3      ----------------------------------------------------------
Kv5.1      ---------------------------------------------------------DT 62
Kv6.1      ------------------------------------------------------TNFDD 100
Kv6.2      ------------------------------------------------------PGHDD 54
Kv6.3      ----------------------------------------------------------
Kv6.4      ------------------------------------------------------RSYEE 96
Kv7.1      ----------------------------------------------------------
Kv7.2      ---------------------------------------------IVTIVVFGVE---YF 142
Kv7.3      ---------------------------------------------TFAIFIFGAE---FA 172
Kv7.4      ---------------------------------------------FVMIVVFGLE---YI 148
Kv7.5      ---------------------------------------------FVMIVVFGLE---FI 176
Kv8.1      ----------------------------------------------------------
Kv8.2      ---------------------------------------------------------AG 79
Kv9.1      ------------------------------------------------------ASEEQ 87
Kv9.2      ------------------------------------------------------HSREA 54
Kv9.3      ------------------------------------------------------HSREA 54
Kv10.1     -----------------------------------------SCKGWG--------KF 151
Kv10.2     -----------------------------------------STKGWT--------KF 149
Kv11.1     --VRRA-----------------------------------SSADDIEAMRAGVLPPPPR 301
Kv11.2     ------------------------------------------RLLSQSFLG-----S 156
Kv11.3     GFGVHP-----------------------------------KNIFRDRHASEDN------G 300
Kv12.1     -----------------------------------------KEDKVK--------GRS 154
Kv12.2     -----------------------------------------GGRRRY---------GR 157
Kv12.3     -----------------------------------------RGDSNHENSL--GRR 159
HCN1       ------------------------------------------IIPVGITFF----TE 169
HCN2       ------------------------------------------IIPVGITFF----KD 238
HCN3       ------------------------------------------VLPVGITFF----KE 120
HCN4       ------------------------------------------IIPVGITFF----KD 289
CatSper1   ----------------------------------------------------------D 68
CatSper2   --------------------------------------------------------SHA 80
CatSper3   ---------------------------------------------------------RF 51
CatSper4   ---------------------------------------------------------GG 23
Hv1        ----------------------------------------------------------
KCa1.1     ----------------------------------------------------VDEKEEAV 152
KCa4.1     ENLSLLT----------------------------------SFYFCIVTFSTVGYGDVTPKIWP 326
KCa4.2     KKLNLFD----------------------------------SLYFCIVTFSTVGFGDVTPETWS 254
TPC1       -----------------------------------------APSLSSGGESSFSS 134

Shaker     FCERVVINV-------------SGLRFE-----------------------------TQLR 113
Nav1.1     ---CGNSSDA------------GQCPEG-----------------------------YMCV 352
Nav1.2     ---CGNSSDA------------GQCPEG-----------------------------YICV 354
Nav1.3     ---CGNGSDA------------GQCPEG-----------------------------YICV 353
Nav1.4     ------YGND------------SWYAND-----------------------------TWNS 326
Nav1.5     ---CGNSSDA------------GTCPEG-----------------------------YRCL 342
Nav1.6     LLCGNSSDA-------------GQCPEG-----------------------------YQCM 340
Nav1.7     ---CGFSTDS------------GQCPEG-----------------------------YTCV 331
```

Figure 15K

```
Nav1.8      L-CGNGSDS----------GHCPDG-----------------------------YICL 326
Nav1.9      KMCGIWMGN----------SACSIQ-----------------------------YECK 329
Cav1.1      PGPNHGITH----------FDNPGF--------------------SMLTVYQCITMEG 293
Cav1.2      DGPKHGITN----------FDNPAF--------------------AMLTVFQCITMEG 335
Cav1.3      VGPNGGITN----------FDNPAF--------------------AMLTVFQCITMEG 365
Cav1.4      PGPNGGITN----------FDNFFF--------------------AMLTVFQCVTMEG 331
Cav2.1      EGPNNGITQ----------FDNILF--------------------AVLTVFQCITMEG 319
Cav2.2      PGPNFGITN----------FDNILF--------------------ALLTVFQCITMEG 315
Cav2.3      IGPNDGITQ----------FDNILF--------------------AVLTVFQCITMEG 310
Cav3.1      MREQRVRFL----------SNASTLASFSEPGSCYEELLKYLVYILRKA-ARRLAQVSP 456
Cav3.2      MREQRARHL----------SNDSTLASFSEPGSCYEELLKYVGHIFRKVKRRSLRLYAR 481
Cav3.3      MLEQRQRYL----------SSS-------------------TVASYAEPGDCYEEIFQYVC 443
Kv1.1       CCERVVINI----------SGLRFE-------------------------------TQLK 53
Kv1.2       CCERVVINI----------SGLRFE-------------------------------TQLK 49
Kv1.3       CGERVVINI----------SGLRFE-------------------------------TQLK 120
Kv1.4       CCERVVINV----------SGLRFE-------------------------------TQMK 192
Kv1.5       RHQRVHINI----------SGLRFE-------------------------------TQLG 136
Kv1.6       SSERLVINI----------SGLRFE-------------------------------TQLR 57
Kv1.7       CCERLVLNV----------AGLRFE-------------------------------TRAR 29
Kv1.8       GNQRVIINI----------AGLRFE-------------------------------TQLR 102
Kv2.1       -HEVLWRTL----------DRLPR--------------------------------TRLG 58
Kv2.2       -HEVLWRTL----------DRLPR--------------------------------TRLG 62
Kv3.1       SHFDYDPRA----------DEFFF--------------------------------D--R 59
Kv3.2       GRASDHPGG----------GREFFF-------------------------------D--R 106
Kv3.3       ARFDYDPGA----------DEFFF--------------------------------D--R 139
Kv3.4       GSSGSSGGG----------GCEFFF-------------------------------D--R 98
Kv4.1       -DEVLVVNV----------SGRRFE-------------------------------TWKN 56
Kv4.2       -ALI-VLNV----------SGTRFQ-------------------------------TWQD 57
Kv4.3       -DELIVLNV----------SGRRFQ-------------------------------TWRT 56
Kv5.1       IFSLCDDYD----------PGKREF-------------------------------YFDR 81
Kv6.1       ILNVCDDYD----------VTCNEF-------------------------------FFDR 119
Kv6.2       LLRVCDDYD----------VSRDEF-------------------------------FFDR 73
Kv6.3       VLEVCDDYD----------RERNE--------------------------------YFFD 64
Kv6.4       IVQLCDDYD----------EDSQEF-------------------------------FFDR 115
Kv7.1       VSLDPRVSI----------YSTRRP-------------------------------VLA 102
Kv7.2       VRIWAAGCC----------CRYR---------------------------------GWRG 159
Kv7.3       LRIWAAGCC----------CRYK---------------------------------GWRG 189
Kv7.4       VRVWSAGCC----------CRYR---------------------------------GWQG 165
Kv7.5       IRIWSAGCC----------CRYR---------------------------------GWQG 193
Kv8.1       GKLAVVVAS----------YRRP----------------------------------G 79
Kv8.2       EVTTAKPEG----------PSDPPALL-----------------------------STLNV 101
Kv9.1       ARRLCDDYD----------EAAREF-------------------------------YFDR 106
Kv9.2       ILELCDDYD----------DVQREF-------------------------------YFDR 73
Kv9.3       ILELCDDYD----------DVQREF-------------------------------YFDR 73
Kv10.1      ARLTRALTS----------SRGVL--------------------------------QQLAPSV 172
Kv10.2      ARLTRALTN----------SRSVL--------------------------------QQLTPMN 170
Kv11.1      HASTGAMHP----------LRSGL--------------------------------LNSTSDS 322
Kv11.2      EGSHG---R----------PGGP---------------------------------GPGTG 171
Kv11.3      RNVKGPFNH----------IKSSL--------------------------------LGSTSDS 321
Kv12.1      RAGTHFDSA----------PRRS----------------------------------RAV 170
Kv12.2      ARSKGFNAN----------PRRS----------------------------------RAV 173
Kv12.3      GATWKFPSA----------PRRS----------------------------------RTV 175
HCN1        QTTTPWIIF----------NVAS----------------------------------DTVF 186
HCN2        ETTAPWIVF----------NVVS----------------------------------DTFF 255
HCN3        ENSPPWIVF----------NVLS----------------------------------DTFF 137
HCN4        ENTTPWIVF----------NVVS----------------------------------DTFF 306
CatSper1    QALSSHHQ-----------SHHHSE--------------------------------ARN 86
CatSper2    QRLLSRLHV----------RCSQRPPL------------------------------SL 99
CatSper3    FKIIMISTV----------TSNAFF--------------------------------MAL 69
CatSper4    TQEDRMGFG----------GAVAAL--------------------------------RG 40
```

Figure 15L

```
Hv1         ---KVAPAE-----------RMSKFL-------------------------RHF  28
KCa1.1      AAEVGWMTS-----------VKDWAG-------------------------VMIS 171
KCa4.1      SQLLVVIMI-----------CVA-----------------LVVLPLQFEELVYL 352
KCa4.2      SKLFVVAMI-----------CVA-----------------LVVLPIQFEQLAYL 280
TPC1        PAHNWEMNYQEAAIYLQEGENNDKFF-------------------------THPK 164

Shaker      TLNQFPDTLLGDPAR---------RLR-------------------YFDPLRNEYFF-- 142
Nav1.1      KAGRNPNYGYTSFDTF---------SWAFLSLFRLMTQDFWENLYQLTLRAAGKTYMIFF 403
Nav1.2      KAGRNPNYGYTSFDTF---------SWAFLSLFRLMTQDFWENLYQLTLRAAGKTYMIFF 405
Nav1.3      KAGRNPNYGYTSFDTF---------SWAFLSLFRLMTQDYWENLYQLTLRAAGKTYMIFF 404
Nav1.4      HASWA-TNDTFD-------------WDA------------------YISDEGNFYFLEG 353
Nav1.5      KAGENPDHGYTSFDSF---------AWAFLALFRLMTQDCWERLYQQTLRSAGKIYMIFF 393
Nav1.6      KAGRNPNYGYTSFDTF---------SWAFLALFRLMTQDYWENLYQLTLRAAGKTYMIFF 391
Nav1.7      KIGRNPDYGYTSFDTF---------SWAFLALFRLMTQDYWENLYQQTLRAAGKTYMIFF 382
Nav1.8      KTSDNPDFNYTSFDSF---------AWAFLSLFRLMTQDSWERLYQQTLRTSGKIYMIFF 377
Nav1.9      HTKINPDYNYTNFDNF---------GWSFLAMFRLMTQDSWEKLYQQTLRTTGLYSVFFF 380
Cav1.1      WTDVLYWVNDAIGNEW---------PWIYFVTLI-----------LLGSFFYILNLVLGVL 333
Cav1.2      WTDVLYWMQDAMGYEL---------PWVYFVSLV-----------IFGSFFVLNLVLGVL 375
Cav1.3      WTDVLYWMNDAMGFEL---------PWVYFVSLV-----------IFGSFFVLNLVLGVL 405
Cav1.4      WTDVLYWMQDAMGYEL---------PWVYFVSLV-----------IFGSFFVLNLVLGVL 371
Cav2.1      WTDLLYNSNDASGNTW---------NWLYFIPLI-----------IIGSFFMLNLVLGVL 359
Cav2.2      WTDILYNTNDAAGNTW---------NWLYFIPLI-----------IIGSFFMLNLVLGVL 355
Cav2.3      WTTVLYNTNDALGATW---------NWLYFIPLI-----------IIGSFFVLNLVLGVL 350
Cav3.1      AAGVRVGLLSSPAPLGGQE--TQPSSSCSRS--------------------HRRLSVHHLV 495
Cav3.2      WQSRWRK-----------------KVDPSAV--------------------QGQGPGHRQR 505
Cav3.3      HILRKAK-----------------RPALGLY--------------------Q-----ALQS 462
Kv1.1       TLAQFPNTLLGNPKK---------RMR-------------------YFDPLRNEYFF--  82
Kv1.2       TLAQFPETLLGDPKK---------RMR-------------------YFDPLRNEYFF--  78
Kv1.3       TLCQFPETLLGDPKR---------RMR-------------------YFDPLRNEYFF-- 149
Kv1.4       TLAQFPETLLGDPEK---------RTQ-------------------YFDPLRNEYFF-- 221
Kv1.5       TLAQFPNTLLGDPAK---------RLR-------------------YFDPLRNEYFF-- 165
Kv1.6       TLSLFPDTLLGDPGR---------RVR-------------------FFDPLRNEYFF--  86
Kv1.7       TLGRFPDTLLGDPAR---------RGR-------------------FYDDARREYFF--  58
Kv1.8       TLSQFPETLLGDREK---------RMQ-------------------FFDSMRNEYFF-- 131
Kv2.1       KLRDC-NTHDSLLEV---------CDD-------------------Y-SLDDNEYFFDR  87
Kv2.2       KLRDC-NTHESLLEV---------CDD-------------------Y-NLNENEYFFDR  91
Kv3.1       HPGVF-AHILNY--Y---------RTG-------------------KLHCPADVCGPLY  87
Kv3.2       HPGVF-AYVLNY--Y---------RTG-------------------KLHCPADVCGPLF 134
Kv3.3       HPGVF-AYVLNY--Y---------RTG-------------------KLHCPADVCGPLF 167
Kv3.4       HPGVF-AYVLNY--Y---------RTG-------------------KLHCPADVCGPLF 126
Kv4.1       TLDRYPDTLLGSSEK---------EFF-------------------Y-DADSGEYFFDR  86
Kv4.2       TLERYPDTLLGSSER---------DFF-------------------Y-HPETQQYFFDR  87
Kv4.3       TLERYPDTLLGSTEK---------EFF-------------------F-NEDTKEYFFDR  86
Kv5.1       DPDAFKCVIEVYYFGE--------VHM-------------------KKGICPICF 109
Kv6.1       NPGAFGT---ILTFL---------RAG-------------------KLRLLREMCALSF 147
Kv6.2       SPCAFRA---IVALL---------RAG-------------------KLRLLRGPCALAF 101
Kv6.3       RHSEAFGFILLY------------VRG-------------------HGKLRFAPR  83
Kv6.4       SPSAFGV---IVSFL---------AAG-------------------KLVLLQEMCALSF 143
Kv7.1       RTHVQGR-----------------VYNFLE-------------------------- 115
Kv7.2       RLKFARKPFC--------------VIDI---------------------------M 174
Kv7.3       RLKFARKPLC--------------MLDI---------------------------F 204
Kv7.4       RFRFARKPFC--------------VIDF---------------------------I 180
Kv7.5       RLRFARKPFC--------------VIDT---------------------------I 208
Kv8.1       ALAAVPSPLELC------------DDA-----------------NPVDNEYFFDR 105
Kv8.2       NVGGHSYQLDYCELAGFP------KTRLGRL---------------ATSTSRSRPQLSLC 139
Kv9.1       HPGFFLS---LLHFY---------RTG-------------------HLHVLDELCVPAF 134
Kv9.2       NPELFPY---VLHFY---------HTG-------------------KLHVMAELCVFSF 101
Kv9.3       NPELFPY---VLHFY---------HTG-------------------KLHVMAELCVFSF 101
Kv10.1      QKGENVH-----------------KHSRLAE---------------VLQLGSDILPQYK 199
Kv10.2      -KTEVVH-----------------KHSRLAE---------------VLQLGSDILPQYK 196
Kv11.1      DLVRYRTISKIFQITLNFV-----DLKGDPFL--------------ASPTSDREIIAPK 362
Kv11.2      R-GKYRTISQIFQFTLNFVEFNLEKHRSS-----------------STTEIEIIAPH 210
Kv11.3      NLNKYSTINKIFQLTLNFSEVKTEKKNSSPP---------------SSDKTII---APK 362
```

Figure 15M

```
Kv12.1      LYHISGHLQR------------REKNK--------------------LKI------N  189
Kv12.2      LYHLSGHLQK------------QPKGK--------------------HKL------N  192
Kv12.3      LHRLTGHFGR------------RGQGG--------------------MKA------N  194
HCN1        LLDLIMNFRT------------GTVNED-------------------SSEIILDPK  211
HCN2        LMDLVLNFRT------------GIVIED-------------------NTEIILDPE  280
HCN3        LLDLVLNFRT------------GIVVEE-------------------GAEILLAPR  162
HCN4        LIDLVLNFRT------------GIVVED-------------------NTEIILDPQ  331
CatSper1    HGRAHGPTGFGLAPSQ------GAVPS--------------HRSYGEDYHDELQ  120
CatSper2    WAGWVLECPLFKNFIIFLVFLNTIILMVEIELLE-------------------ST  135
CatSper3    WTSYDIRY-----------------------------------------------  77
CatSper4    RPSPLQSTIH------------ESYG-----------------------------  54
Hv1         TVVGDDY------------------------------------------------  35
KCa1.1      AQTLTGRVLVVLVFALSIGALVIYFIDSSNPIESCQNFYKDFTLQIDMAFNVFFLLYFGL  231
KCa4.1      WMERQKS---------------GGNYS----------------------------  364
KCa4.2      WMERQKS---------------GGNYS----------------------------  292
TPC1        DAKALAAYLFAHNHLFYLM----ELATALLLLLSLCEAPA------VPALRLGIYVHAT  214

Shaker      ----DRSRPSFD--AIL--------------YY--YQ------------------  157
Nav1.1      VLVIFLGSFYLI--NLILA------------VVAMAYEEQNQATLEEAEQKEAEFQQMIEQ  450
Nav1.2      VLVIFLGSFYLI--NLILA------------VVAMAYEEQNQATLEEAEQKEAEFQQMLEQ  452
Nav1.3      VLVIFLGSFYLV--NLILA------------VVAMAYEEQNQATLEEAEQKEAEFQQMLEQ  451
Nav1.4      S-----NDALLC--GNSSD------------AGHCPK-----------------  371
Nav1.5      MLVIFLGSFYLV--NLILA------------VVAMAYEEQNQATI---------AE--  426
Nav1.6      VLVIFVGSFYLV--NLILA------------VVAMAYEEQNQATLEEAEQKEAEFKAMLEQ  438
Nav1.7      VVVIFLGSFYLI--NLILA------------VVAMAYEEQNQANTEEAKQKELEFQQMLDR  429
Nav1.8      VLVIFLGSFYLV--NLILA------------VVTMAYEEQNQATT----------  408
Nav1.9      IVVIFLGSFYLI--NLILA------------VVTMAYEEQN-------------  407
Cav1.1      SGEFTKEREKAK--SRGTF------------QKLREKQQLDEDLRGYMSWITQ--------  372
Cav1.2      SGEFSKEREKAK--ARGDF------------QKLREKQQLEEDLKGYLDWITQAEDIDPEN  422
Cav1.3      SGEFSKEREKAK--ARGDF------------QKLREKQQLEEDLKGYLDWITQAEDIDPEN  452
Cav1.4      SGEFSKEREKAK--ARGDF------------QKQREKQQMEEDLRGYLDWITQAEELDMED  418
Cav2.1      SGEFAKERERVE--NRRAF------------LKLRRQQIERELNGYMEWISKAEE-----  401
Cav2.2      SGEFAKERERVE--NRRAF------------LKLRRQQIERELNGYLEWIFKAEE-----  397
Cav2.3      SGEFAKERERVE--NRRAF------------MKLRRQQIERELNGYRAWIDKAEE-----  392
Cav3.1      HHHHHHHHHYHL--GNGTL------------RAPRASPEIQDRDANGSRRLMLPPPSTPAL  542
Cav3.2      RAGRHTASVHHL--VY---------------HHHHHHH---HHYHFSHGSPRRPGPEPGAC  546
Cav3.3      RRQALGPEAPAP--AK---------------PGPHAKE----PRHYQLCPQ---------  492
Kv1.1       ----DRNRPSFD--AIL--------------YY--YQ------------------  97
Kv1.2       ----DRNRPSFD--AIL--------------YY--YQ------------------  93
Kv1.3       ----DRNRPSFD--AIL--------------YY--YQ------------------  164
Kv1.4       ----DRNRPSFD--AIL--------------YY--YQ------------------  236
Kv1.5       ----DRNRPSFD--GIL--------------YY--YQ------------------  180
Kv1.6       ----DRNRPSFD--AIL--------------YY--YQ------------------  101
Kv1.7       ----DRHRPSFD--AVL--------------YY--YQ------------------  73
Kv1.8       ----DRNRPSFD--GIL--------------YY--YQ------------------  146
Kv2.1       HPGAFTSILNFY--RTGPL------------HM----------------------  106
Kv2.2       HPGAFTSILNFY--RTGKL------------HM----------------------  110
Kv3.1       EEELAFWGIDET--DVEPC------------CW--MT------------------  108
Kv3.2       EEELAFWGIDET--DVEPC------------CW--MT------------------  155
Kv3.3       EEELGFWGIDET--DVEAC------------CW--MT------------------  188
Kv3.4       EEELTFWGIDET--DVEPC------------CW--MT------------------  147
Kv4.1       DPDMFRHVLNFY--RTGPL------------HCPRQE------------------  109
Kv4.2       DPDIFRHILNFY--RTGKL------------HYPRHE------------------  110
Kv4.3       DPEVFRCVLNFY--RTGKL------------HYPRYE------------------  109
Kv5.1       RNEMDFWKVDLK--FLEDC------------CK----------------------  128
Kv6.1       QEELLYWGIAED--RLE--------------GC--CK------------------  166
Kv6.2       RDELAYWGIDEA--RLE--------------RC--CL------------------  120
Kv6.3       MCELSFYNEMIY--WGLEG------------AHLEYC------------------  111
Kv6.4       QEELAYWGIEEA--RLE--------------RC--CL------------------  162
Kv7.1       ----RPTGWKCF--VYHFA------------VFLIVL-----------------  134
Kv7.2       VLIASIAVLA-------AGSQG---------NVFATS-----------------  195
Kv7.3       VLIASVPVVA-------VGNQG---------NVLATS-----------------  225
Kv7.4       VFVASVAVIA-------AGTQG---------NIFATS-----------------  201
```

Figure 15N

```
Kv7.5       VLIASIAVVS----AKTQG----------NIFATS------------------------ 229
Kv8.1       SSQAFRYVLHYY--RTGRL----------HVMEQL------------------------ 128
Kv8.2       DDYEEQTDEYFF--DRDPA----------VFQLVY------------------------ 162
Kv9.1       GQEADYWGLGEN--ALA------------AC--CR------------------------ 153
Kv9.2       SQEIEYWGINEF--FID------------SC--CS------------------------ 120
Kv9.3       SQEIEYWGINEF--FID------------SC--CS------------------------ 120
Kv10.1      QEAPKTPPHIIL--HYCVF----------KTTWDW------------------------ 222
Kv10.2      QEAPKTPPHIIL--HYCAF----------KTTWDW------------------------ 219
Kv11.1      IKE-RTHNVTEK--VTQVL----------SLGADVLPE---------------------- 387
Kv11.2      KVVERTQNVTEK--VTQVL----------SLGADVLPE---------------------- 236
Kv11.3      VKD-RTHNVTEK--VTQVL----------SLGADVLPE---------------------- 387
Kv12.1      NNVFVDKPAFPE--YK-------------VSDAKK------------------------ 209
Kv12.2      KGVFGEKPNLPE--YK-------------VAAIRK------------------------ 212
Kv12.3      NNVFPKPSVPE---YK-------------VASVGG------------------------ 214
HCN1        VIKMNYLKSWFV--VDFIS----------SIPVDYIFL---------------------- 237
HCN2        KIKKKYLRTWFV--VDFVS----------SIPVDYIFL---------------------- 306
HCN3        AIRTRYLRTWFL--VDLIS----------SIPVDYIFL---------------------- 188
HCN4        RIKMKYLKSWFM--VDFIS----------SIPVDYIFL---------------------- 357
CatSper1    RDGRRHHDGSQY--GGFHQQ---------SDSHYH------------------------ 144
CatSper2    NTKLWPLKLTLE--VAAWFILLIFILEILLKWLSNF------------------------ 169
CatSper3    ----RLFRLLEF--SEIFF----------VSICTSEL---------------------- 98
CatSper4    ----RPEEQVLI--NRQEI----------TN---------------------------- 69
Hv1         ----HAWNINYK--KWENEEEEEEEQPPPTP---------------------------- 61
KCa1.1      RFIAANDKLWFWLEVNSVVDFFTVPPVFVSVYLNRSWLGLRFLRALRLIQFSEILQFL-- 289
KCa4.1      RHRAQTEKHVVL--CV-------------SSLKIDL----LMDFLNEF---------- 393
KCa4.2      RHRAQTEKHVVL--CV-------------SSLKIDL----LMDFLNEF---------- 321
TPC1        LELFALMVVVFELCMKLRWLGLHTFI----RHKRTM------------------------ 246

Shaker      ------------------------------------------------------------
Nav1.1      LKKQQEEAAQQAATATASEHSREPSAAGRL-------SD---SSSEASKLSSKSAKERRNR 500
Nav1.2      LKKQQEEAQAAAAAA-SAESRDFSGAGGI--------GVFSESSSVASKLSSKSEKELKNR 504
Nav1.3      LKKQQEEAQAVAAA--SAASRDFSGIGGL--------GELLESSSEASKLSSKSAKEWRNR 502
Nav1.4      -----------------------------------------GYECIKT--GR---NPNYG 385
Nav1.5      --------------------------TEEKEKRFQE----------AMEMLKK--EHEALTIRGV 453
Nav1.6      LKKQQEEEAQAAAAMAT----SAGTVSEDAIEEEGEEGGGSPRSSSEISKLSSKSAKERRNR 494
Nav1.7      LKKEQEEAEAIAAAA--AEYTSIRR-SRI-------MGLSESSSETSKLSSKSAKERRNR 479
Nav1.8      ---------------------DEIEAKEKKFQE-----ALEMLRKEQEVLAALGIDTTSLHS 444
Nav1.9      ---------------------------------------------------KNVA 411
Cav1.1      ------------------------------------------------------------
Cav1.2      EDEGM------------------------------------------------------ 427
Cav1.3      EEEG------------------------------------------------------- 456
Cav1.4      PSADDNLGPQLAELT--------------------------------------------- 433
Cav2.1      ------------------------------------------------------------
Cav2.2      ------------------------------------------------------------
Cav2.3      ------------------------------------------------------------
Cav3.1      SGAPPG----------------------------------------------------- 548
Cav3.2      DTRLVRAGAPPSPPS-------------------------------------------- 561
Cav3.3      ------------------------------------------------------------
Kv1.1       ------------------------------------------------------------
Kv1.2       ------------------------------------------------------------
Kv1.3       ------------------------------------------------------------
Kv1.4       ------------------------------------------------------------
Kv1.5       ------------------------------------------------------------
Kv1.6       ------------------------------------------------------------
Kv1.7       ------------------------------------------------------------
Kv1.8       ------------------------------------------------------------
Kv2.1       ------------------------------------------------------------
Kv2.2       ------------------------------------------------------------
Kv3.1       ------------------------------------------------------------
Kv3.2       ------------------------------------------------------------
Kv3.3       ------------------------------------------------------------
Kv3.4       ------------------------------------------------------------
Kv4.1       ------------------------------------------------------------
```

Figure 15O

```
Kv4.2      ------------------------------------------------------------
Kv4.3      ------------------------------------------------------------
Kv5.1      ------------------------------------------------------------
Kv6.1      ------------------------------------------------------------
Kv6.2      ------------------------------------------------------------
Kv6.3      ------------------------------------------------------------
Kv6.4      ------------------------------------------------------------
Kv7.1      ------------------------------------------------------------
Kv7.2      ------------------------------------------------------------
Kv7.3      ------------------------------------------------------------
Kv7.4      ------------------------------------------------------------
Kv7.5      ------------------------------------------------------------
Kv8.1      ------------------------------------------------------------
Kv8.2      ------------------------------------------------------------
Kv9.1      ------------------------------------------------------------
Kv9.2      ------------------------------------------------------------
Kv9.3      ------------------------------------------------------------
Kv10.1     ------------------------------------------------------------
Kv10.2     ------------------------------------------------------------
Kv11.1     ------------------------------------------------------------
Kv11.2     ------------------------------------------------------------
Kv11.3     ------------------------------------------------------------
Kv12.1     ------------------------------------------------------------
Kv12.2     ------------------------------------------------------------
Kv12.3     ------------------------------------------------------------
HCN1       ------------------------------------------------------------
HCN2       ------------------------------------------------------------
HCN3       ------------------------------------------------------------
HCN4       ------------------------------------------------------------
CatSper1   ------------------------------------------------------------
CatSper2   ------------------------------------------------------------
CatSper3   ------------------------------------------------------------
CatSper4   ------------------------------------------------------------
Hv1        ------------------------------------------------------------
KCa1.1     ------------------------------------------------------------
KCa4.1     ------------------------------------------------------------
KCa4.2     ------------------------------------------------------------
TPC1       ------------------------------------------------------------

Shaker     ------------------------------------------------------------
Nav1.1     RKKRKQKEQSGGEEKDEDEFQ-KSESEDSIRRKGFRFSIEGNRLTYEKRYSSPHQSLLSI 559
Nav1.2     RKKKKQKEQSGEEEKNDRVR--KSESEDSIRRKGFRFSLEGSRLTYEKRFSSPHQSLLSI 562
Nav1.3     RKKRRQPEHLEGNNKGERDSFPKSESEDSVKRSSFLFSMDGNRLTSDKKFCSPHQSLLSI 562
Nav1.4     YTSYDTF-----------SWAFLALFRLMTQDYWEN---LFQLTLRAAGKTYMIFFVVIIFLG- 434
Nav1.5     DTVSRSSLEMSPLAPVNSHERRSKRRKRMSSGT---EECGEDRLPKSDSEDGPRAMNHLSL 511
Nav1.6     RKKRKQKELSEGEEKGDPEKVFKSESEDGMRRK---AFRLPDNRI---GRKFSIMNQSLLSI 550
Nav1.7     RKKKNQKKLSSGEEKGDAEKLSKSESEDSIRRKSFHLGVEGHRPAHEKRLSTPNQSPLSI 539
Nav1.8     HNGSPLT---------SKNASERRHRIKPRVSEGS------TEDNKSPRSDPYNQRRMSFLGL 492
Nav1.9     AEIEAKE---------KMFQEAQQLLKEEKEALV--------AMGIDRSSLTSLETSYF---- 453
Cav1.1     ------------------------------------------------------------
Cav1.2     ------------------------------------------------------------
Cav1.3     ------------------------------------------------------------
Cav1.4     ------------------------------------------------------------
Cav2.1     ------------------------------------------------------------
Cav2.2     ------------------------------------------------------------
Cav2.3     ------------------------------------------------------------
Cav3.1     ------------------------------------------------------------
Cav3.2     ------------------------------------------------------------
Cav3.3     ------------------------------------------------------------
Kv1.1      ------------------------------------------------------------
Kv1.2      ------------------------------------------------------------
Kv1.3      ------------------------------------------------------------
Kv1.4      ------------------------------------------------------------
```

Figure 15P

```
Kv1.5       ----------------------------------------------------------------
Kv1.6       ----------------------------------------------------------------
Kv1.7       ----------------------------------------------------------------
Kv1.8       ----------------------------------------------------------------
Kv2.1       ----------------------------------------------------------------
Kv2.2       ----------------------------------------------------------------
Kv3.1       ----------------------------------------------------------------
Kv3.2       ----------------------------------------------------------------
Kv3.3       ----------------------------------------------------------------
Kv3.4       ----------------------------------------------------------------
Kv4.1       ----------------------------------------------------------------
Kv4.2       ----------------------------------------------------------------
Kv4.3       ----------------------------------------------------------------
Kv5.1       ----------------------------------------------------------------
Kv6.1       ----------------------------------------------------------------
Kv6.2       ----------------------------------------------------------------
Kv6.3       ----------------------------------------------------------------
Kv6.4       ----------------------------------------------------------------
Kv7.1       ----------------------------------------------------------------
Kv7.2       ----------------------------------------------------------------
Kv7.3       ----------------------------------------------------------------
Kv7.4       ----------------------------------------------------------------
Kv7.5       ----------------------------------------------------------------
Kv8.1       ----------------------------------------------------------------
Kv8.2       ----------------------------------------------------------------
Kv9.1       ----------------------------------------------------------------
Kv9.2       ----------------------------------------------------------------
Kv9.3       ----------------------------------------------------------------
Kv10.1      ----------------------------------------------------------------
Kv10.2      ----------------------------------------------------------------
Kv11.1      ----------------------------------------------------------------
Kv11.2      ----------------------------------------------------------------
Kv11.3      ----------------------------------------------------------------
Kv12.1      ----------------------------------------------------------------
Kv12.2      ----------------------------------------------------------------
Kv12.3      ----------------------------------------------------------------
HCN1        ----------------------------------------------------------------
HCN2        ----------------------------------------------------------------
HCN3        ----------------------------------------------------------------
HCN4        ----------------------------------------------------------------
CatSper1    ----------------------------------------------------------------
CatSper2    ----------------------------------------------------------------
CatSper3    ----------------------------------------------------------------
CatSper4    ----------------------------------------------------------------
Hv1         ----------------------------------------------------------------
KCa1.1      ----------------------------------------------------------------
KCa4.1      ----------------------------------------------------------------
KCa4.2      ----------------------------------------------------------------
TPC1        ----------------------------------------------------------------

Shaker      ----------------------------------------------------------------
Nav1.1      RGSLFSPRRNSRTSLFSFRG--RAKDVGSENDFADDEHSTFEDNESRRDSLF-------VPR  612
Nav1.2      RGSLFSPRRNSRASLFSFRG--RAKDIGSENDFADDEHSTFEDNDSRRDSLF-------VPH  615
Nav1.3      RGSLFSPRRNSKTSIFSFRG--RAKDVGSENDFADDEHSTFEDSESRRDSLF-------VPH  615
Nav1.4      ---SFYLINLILAVVA-----------MAYAEQNEATLAED----------KEKEEEF---------Q  469
Nav1.5      TRGLSRTSMKPRSSRGSIFTF-RPRRDLGSEADFADDENSTAGESESHHTSLL---------V  563
Nav1.6      PGSPFLSRHNSKSSIFSFRGPGRFRDPGSENEFADDEHSTVEESEGRRDSLFIPIRAPER  610
Nav1.7      RGSLFSPRRNSRTSLFSFKG--RGRDIGSETEFADDEHSIFGDNESRRGSLF-------VPH  592
Nav1.8      ASG----KRRASHGSVFHFRSPGRDISLPEGVTDDGVFPGD----HESHRGSLL---------  538
Nav1.9      -------------------------------------------TPKKRKLFG----------  462
Cav1.1      -------------------GEVMDVEDFR---------------EGKLSLDEGG-------  392
Cav1.2      -----------------DEEKPRNMSMPTSETES--------VNTENVAGGDIEG-------  457
Cav1.3      -----------------GEEGKRNTSMPTSETES--------VNTENVSGEGENR-------  486
```

Figure 15Q

```
Cav1.4     ---------------NRRRGRLRWFSHSTRSTHSTSSHASLPASDTGSMEETQGDEDEEEG  479
Cav2.1     ---------------VILAEDETDGEQRHPFDGAL----RRTTIKKSKTDLINPEEAED     441
Cav2.2     ---------------VMLAEEDRNAEEKSPLDVLK----RAAT-KKSRNDLIHAEEGED     436
Cav2.3     ---------------VMLAEENKNAGTSALEVL------RRATIKRSRTEAMTRDSSDE     430
Cav3.1     ----------GAESVHSFYHADCHLEPVRCQAPPPRSPSEASGRTVGSGKVYPT------  592
Cav3.2     ----PGRGPPDAESVHSIYHADCHIE------------GPQERARVAHAAATAAAS----  601
Cav3.3     ---------------HSPLDATPHTL------------VQPIPATLASDPA---------  516
Kv1.1      ------------------------------------------------------------
Kv1.2      ------------------------------------------------------------
Kv1.3      ------------------------------------------------------------
Kv1.4      ------------------------------------------------------------
Kv1.5      ------------------------------------------------------------
Kv1.6      ------------------------------------------------------------
Kv1.7      ------------------------------------------------------------
Kv1.8      ------------------------------------------------------------
Kv2.1      ------------------------------------------------------------
Kv2.2      ------------------------------------------------------------
Kv3.1      ------------------------------------------------------------
Kv3.2      ------------------------------------------------------------
Kv3.3      ------------------------------------------------------------
Kv3.4      ------------------------------------------------------------
Kv4.1      ------------------------------------------------------------
Kv4.2      ------------------------------------------------------------
Kv4.3      ------------------------------------------------------------
Kv5.1      ------------------------------------------------------------
Kv6.1      ------------------------------------------------------------
Kv6.2      ------------------------------------------------------------
Kv6.3      ------------------------------------------------------------
Kv6.4      ------------------------------------------------------------
Kv7.1      ------------------------------------------------------------
Kv7.2      ---------------------------------------ALRSLRFLQIL------    206
Kv7.3      ---------------------------------------L-RSLRFLQIL------    235
Kv7.4      ---------------------------------------ALRSMRFLQIL------    212
Kv7.5      ---------------------------------------ALRSLRFLQIL------    240
Kv8.1      ------------------------------------------------------------
Kv8.2      ------------------------------------------------------------
Kv9.1      ------------------------------------------------------------
Kv9.2      ------------------------------------------------------------
Kv9.3      ------------------------------------------------------------
Kv10.1     ------------------------------------------------------------
Kv10.2     ------------------------------------------------------------
Kv11.1     ------------------------------------YKLQAPRIHRWTI----------  400
Kv11.2     ------------------------------------YKLQAPRIHRWTI----------  249
Kv11.3     ------------------------------------YKLQTPRINKFTI----------  400
Kv12.1     ---------------------------------------SKFIL--------------  214
Kv12.2     ---------------------------------------SPFIL--------------  217
Kv12.3     ---------------------------------------SRCLL--------------  219
HCN1       ------------------------------------IVE-KGMDSEVY-----------  248
HCN2       ------------------------------------IVE---KGIDSEVY---------  317
HCN3       ------------------------------------VVELEPRLDAEVY----------  201
HCN4       ------------------------------------IVE--TRIDSEVY----------  368
CatSper1   ------------------------------------------------------------
CatSper2   ------------------------------------------------------------
CatSper3   ------------------------------------------------------------
CatSper4   ------------------------------------------------------------
Hv1        ------------------------------------------------------------
KCa1.1     ------------------------------------------------------------
KCa4.1     ---------------YAHPRLQ--------------DYYVVILC--------------  408
KCa4.2     ---------------YAHPRLQ--------------DYYVVILC--------------  336
TPC1       ------------------------------------------------------------
```

Figure 15R

```
Shaker  ------------------------------SGGRLRRP------------------------------ 165
Nav1.1  RHGERRNSNLSQTSRSSRMLAVFPANGKMHSTVDC----NGVVSL-VGGPSVPTSPVGQL 667
Nav1.2  RHGERRHSNVSQASRASRVLPILPMNGKMHSAVDC----NGVVSL-VGGPSTLTSA-GQL 669
Nav1.3  RHGERRNSNVSQASRMSSRMVPGLPANGKMHSTVDC----NGVVSL-VGGPSALTSPTGQL 670
Nav1.4  QMLEKFKKHQEELE-KAKAAQA-LEGGEADGDPAH----GKDCN-----GSLDTSQGEK- 517
Nav1.5  PWPLRRTSAQGQPSPGTSAPGH-ALHGKKNSTVDC----NGVVSLLGAGDPEATSPGSHL 618
Nav1.6  RSSYSGYSGYSQGSRSSRIFPSLRRSVKRNSTVDC----NGVVSL-IGGPG--SHIGGRL 663
Nav1.7  RPQERRSSNISQASRSPPMLP---VNGKMHSAVDC----NGVVSL-VDGRSALMLPNGQL 644
Nav1.8  ----LGGGAGQQGPLPRSPLPQPSNPDSRHGEDEHQPPPTSELAPGAVDVSAPD------ 588
Nav1.9  ----NKKRKSFFLRESGKDQPPGSDSDEDCQKKPQLLEQTKRLSQ--------------- 503
Cav1.1  ---SDTESLY--EIAGLNKIIQFIRHWRQWNRIFRWKCHDIVKSK--------------- 432
Cav1.2  --ENCGARLA--HRISKSKFS---RYWRRWNRFCRRKCRAAVKSN--------------- 495
Cav1.3  --GCCG-SLC--QAISKSKLS---RRWRRWNRFNRRRCRAAVKSV--------------- 523
Cav1.4  ALASCTRCLN--KIMKTRVCR---RLRRANRVL-RARCRRAVKSN--------------- 518
Cav2.1  QLADIASVGSPFARASIKSAKLENSTFFHKKERRMRFYIRRMVKTQ-------------- 487
Cav2.2  RFADLCAVGSPFARASLKSGKTESSSYFRRKEKMFRFFIRRMVKAQ-------------- 482
Cav2.3  HCVDISSVGTPLARASIKSAKVDGVSYFRHKERLLRISIRHMVKSQ-------------- 476
Cav3.1  ---------VHTSPPPETLKEKALVEVAASSGPPPTLTSLNIPPGPYSSMHKLLETQSTGA 643
Cav3.2  --LRLATGLGTMN----YPTILPSGVGSGKGSTSP--------GPKGKWAGGPP--GTGG 645
Cav3.3  ---------SCPC----CQH----EDGRRPSGL-------------GSTDSGQE--G-SG 543
Kv1.1   ------------------------------SGGRLRRP------------------------------ 105
Kv1.2   ------------------------------SGGRLRRP------------------------------ 101
Kv1.3   ------------------------------SGGRIRRP------------------------------ 172
Kv1.4   ------------------------------SGGRLKRP------------------------------ 244
Kv1.5   ------------------------------SGGRLRRP------------------------------ 188
Kv1.6   ------------------------------SGGRLRRP------------------------------ 109
Kv1.7   ------------------------------SGGRLRRP------------------------------ 81
Kv1.8   ------------------------------SGGKIRRP------------------------------ 154
Kv2.1   --------------------------------MEEMCA-------------------------------- 112
Kv2.2   --------------------------------MEEMCA-------------------------------- 116
Kv3.1   ----------------------------YRQHRDAEEEAL---------------------------- 119
Kv3.2   ----------------------------YRQHRDAEEEAL---------------------------- 166
Kv3.3   ----------------------------YRQHRDAEEEAL---------------------------- 199
Kv3.4   ----------------------------YRQHRDAEEEAL---------------------------- 158
Kv4.1   ----------------------------CIQAFDEELAF----------------------------- 120
Kv4.2   ----------------------------CISAYDEELAF----------------------------- 121
Kv4.3   ----------------------------CISAYDDELAF----------------------------- 120
Kv5.1   ----------------------------SHLSEKREELEE---------------------------- 140
Kv6.1   ------------------------------RRYLQKIE------------------------------ 174
Kv6.2   ------------------------------RRLRRPEE------------------------------ 128
Kv6.3   ------------------------------CQRRLDD------------------------------- 118
Kv6.4   ------------------------------RKLLRKLE------------------------------ 170
Kv7.1   ----------------------------VCLIFSVLSTIE---------------------------- 146
Kv7.2   ----------------------------RMIRMDRRGG----------------------------- 216
Kv7.3   ----------------------------RMLRMDRRGG----------------------------- 245
Kv7.4   ----------------------------RMVRMDRRGG----------------------------- 222
Kv7.5   ----------------------------RMVRMDRRGG----------------------------- 250
Kv8.1   ------------------------------CALSFLQEI----------------------------- 137
Kv8.2   ------------------------------NFYLSGVL------------------------------ 170
Kv9.1   ------------------------------ARYLEPRLTQ---------------------------- 163
Kv9.2   ------------------------------YSYHGRKVEP---------------------------- 130
Kv9.3   ------------------------------YSYHGRKVEP---------------------------- 130
Kv10.1  --------------------------------IILILTF----------------------------- 229
Kv10.2  --------------------------------VILILTF----------------------------- 226
Kv11.1  --------------------------------LHYSPFKA---------------------------- 408
Kv11.2  --------------------------------LHYSPFKA---------------------------- 257
Kv11.3  --------------------------------LHYSPFKA---------------------------- 408
Kv12.1  --------------------------------LHFSTFKA---------------------------- 222
Kv12.2  --------------------------------LHCGALPA---------------------------- 225
```

Figure 15S

```
Kv12.3      ------------------------LHYSVSKA------------------------ 227
HCN1        ------------------------KTARALRIVR---------------------- 258
HCN2        ------------------------KTARALRIVR---------------------- 327
HCN3        ------------------------KTARALRIVR---------------------- 211
HCN4        ------------------------KTARALRIVR---------------------- 378
CatSper1    ------------------------RGSHHGRPQYL--------------------- 155
CatSper2    ------------------------SVFWKSA------------------------- 176
CatSper3    ------------------------SMKVYVDP------------------------ 106
CatSper4    ------------------------KADAWDMQEFI--------------------- 80
Hv1         ------------------------VSGEEGR------------------------- 68
KCa1.1      --------------------NILKTSNSIKLVNLLSIFI----------------- 308
KCa4.1      ---------PTEM-----------DVQVRRVLQI---------------------- 422
KCa4.2      ---------PTEM-----------DVQVRRVLQI---------------------- 350
TPC1        ------------------------VKTSVLVVQFVEAI------------------ 260

Shaker      --------------------------------------------------------
Nav1.1      LPEVIIDKPATDDNGTTTETEMRKRPSSSFHVSMDFLEDP---SQRQRAMSIASILTNT- 723
Nav1.2      LPEG-----------TTTETEIRKRPSSSYHVSMDLLEDP---TSRQRAMSIASILTNT- 714
Nav1.3      PPEG-----------TTTETEVRKRPLSSYQISMEMLEDS---SGRQRAVSIASILTNT- 715
Nav1.4      ---GAP--------------------------RQSGSG------------DSGISDA- 533
Nav1.5      LRPVMLEHPP-----DTTTPSEEPGGPQMLTSQAPCVDGFEEPGARQRALSAVSVLTSA- 672
Nav1.6      LPEA------------TTEVEIKKKGPGSLLVSMDQLASY---GRKDRINSIMSVVTNTL 708
Nav1.7      LPEG------------TTNQIHKKRPCSSYLLSEDMLNDP---NLRQRAMSRASILTNT- 688
Nav1.8      -----------------------AGQKKTFLSAEYLDEP---FRAQRAMSVVSIITSV- 620
Nav1.9      -------------------------NLSLDHFDEHGDPL--QRQRALSAVSILTIF- 532
Cav1.1      --------------VFYWLVILIVALNTLSIASEHHNQPHWLTRLQDIANRVLLSLFTF- 477
Cav1.2      --------------VFYWLVIFLVFLNTLTIASEHYNQPNWLTEVQDTANKALLALFTA- 540
Cav1.3      --------------TFYWLVIVLVFLNTLTISSEHYNQPDWLTQIQDIANKVLLALFTC- 568
Cav1.4      --------------ACYWAVLLVFLNTLTIASEHHGQPVWLTQIQEYANKVLLCLFTV- 563
Cav2.1      --------------AFYWTVLSLVALNTLCVAIVHYNQPEWLSDFLYYAEFIFLGLFMS- 532
Cav2.2      --------------SFYWVVLCVVALNTLCVAMVHYNQPRRLTTFLYFAEFVFLGLFLT- 527
Cav2.3      --------------VFYWIVLSLVALNTACVAIVHHNQPQWLTHLLYYAEFLFLGLFLL- 521
Cav3.1      CQ-------------------------SSCKISSPCLKADSGACGPDSCPY--- 669
Cav3.2      HGPLSLNSPDPYEK----------------IPHVVGEHGL--GQAPGHLSGLSVPCPL- 685
Cav3.3      SG-----------------------------SSAG--GE--DEADGD----GA----- 559
Kv1.1       --------------------------------------------------------
Kv1.2       --------------------------------------------------------
Kv1.3       --------------------------------------------------------
Kv1.4       --------------------------------------------------------
Kv1.5       --------------------------------------------------------
Kv1.6       --------------------------------------------------------
Kv1.7       --------------------------------------------------------
Kv1.8       --------------------------------------------------------
Kv2.1       --------------------------------------------------------
Kv2.2       --------------------------------------------------------
Kv3.1       --------------------------------------------------------
Kv3.2       --------------------------------------------------------
Kv3.3       --------------------------------------------------------
Kv3.4       --------------------------------------------------------
Kv4.1       --------------------------------------------------------
Kv4.2       --------------------------------------------------------
Kv4.3       --------------------------------------------------------
Kv5.1       --------------------------------------------------------
Kv6.1       --------------------------------------------------------
Kv6.2       --------------------------------------------------------
Kv6.3       --------------------------------------------------------
Kv6.4       --------------------------------------------------------
Kv7.1       --------------------------------------------------------
Kv7.2       ------------------------TWKLLG------SV------------------ 224
```

Figure 15T

```
Kv7.3       -----------------------------------TWKLLG-------SA------------ 253
Kv7.4       -----------------------------------TWKLLG-------SV------------ 230
Kv7.5       -----------------------------------TWKLLG-------SV------------ 258
Kv8.1       --------------------------------------------------------------
Kv8.2       --------------------------------------------------------------
Kv9.1       --------------------------------------------------------------
Kv9.2       --------------------------------------------------------------
Kv9.3       --------------------------------------------------------------
Kv10.1      -------------------------------------YTA---------ILVPY--------- 237
Kv10.2      -------------------------------------YTA---------IMVPY--------- 234
Kv11.1      ----------------------------------VWDWLILLLVIYTAVFT--------- 425
Kv11.2      ----------------------------------VWDWLILLLVIYTAVFT--------- 274
Kv11.3      ----------------------------------VWDWLILLLVIYTAIFT--------- 425
Kv12.1      ----------------------------------GWD------WLILLA-T--------- 232
Kv12.2      ----------------------------------TWD------GFILLA-T--------- 235
Kv12.3      ----------------------------------IWD------GLILLA-T--------- 237
HCN1        ----------------------------------FTKILSLLRLLRLSRLI--------- 275
HCN2        ----------------------------------FTKILSLLRLLRLSRLI--------- 344
HCN3        ----------------------------------FTKILSLLRLLRLSRLI--------- 228
HCN4        ----------------------------------FTKILSLLRLLRLSRLI--------- 395
CatSper1    --------------------------------------------------------------
CatSper2    --------------------------------------------------------------
CatSper3    --------------------------------------------------------------
CatSper4    --------------------------------------------------------------
Hv1         --------------------------------------------------------------
KCa1.1      --------------------------------------------------------------
KCa4.1      ---------------------------PLWSQRVI--YLQGSALK--------- 438
KCa4.2      ---------------------------PMWSQRVI--YLQGSALK--------- 366
TPC1        --------------------------------------------------------------

Shaker      ------------------------------------------------------VNV 168
Nav1.1      VEELEESRQKCPPCWYKFSNIFLIWDCSPYWLKVKHVVNLVVMDPFVDLAITICIVLNTL 783
Nav1.2      MEELEESRQKCPPCWYKFANMCLIWDCCKPWLKVKHLVNLVVMDPFVDLAITICIVLNTL 774
Nav1.3      MEELEESRQKCPPCWYRFANVFLIWDCCDAWLKVKHLVNLIVMDPFVDLAITICIVLNTL 775
Nav1.4      MEELEEAHQKCPPWWYKCAHKVLIWDCCAPWLKFKNIIHLIVMDPFVDLGITICIVLNTL 593
Nav1.5      LEELEESRHKCPPCWNRLAQRYLIWECCPLWMSIKQGVKLVVMDPFTDLTITMCIVLNTL 732
Nav1.6      VEELEESQRKCPPCWYKFANTFLIWECHPYWIKLKEIVNLIVMDPFVDLAITICIVLNTL 768
Nav1.7      VEELEESRQKCPPWWYRFAHKFLIWNCSPYWIKFKKCIYFIVMDPFVDLAITICIVLNTL 748
Nav1.8      LEELEESEQKCPPCLTSLSQKYLIWDCCPMWVKLKTILFGLVTDPFAELTITLCIVVNTI 680
Nav1.9      MKEQEKSQEPCLPCGENLASKYLVWNCCPQWLCVKKVLRTVMTDPFTELAITICIIINTV 592
Cav1.1      ------------------------------------------------EMLMK 482
Cav1.2      ------------------------------------------------EMLLK 545
Cav1.3      ------------------------------------------------EMLVK 573
Cav1.4      ------------------------------------------------EMLLK 568
Cav2.1      ------------------------------------------------EMPIK 537
Cav2.2      ------------------------------------------------EMSLK 532
Cav2.3      ------------------------------------------------EMSLK 526
Cav3.1      --------------------------------------CARAGAGEVELADRE 684
Cav3.2      ------------------------------PSPPAGTLTCELKSCPYCTRALEDPEGELSGSE 718
Cav3.3      ------------------------------------------------RSSE 563
Kv1.1       ------------------------------------------------VNV 108
Kv1.2       ------------------------------------------------VNV 104
Kv1.3       ------------------------------------------------VNV 175
Kv1.4       ------------------------------------------------VNV 247
Kv1.5       ------------------------------------------------VNV 191
Kv1.6       ------------------------------------------------VNV 112
Kv1.7       ------------------------------------------------AHV 84
Kv1.8       ------------------------------------------------ANV 157
Kv2.1       ------------------------------------------------LSFS 116
Kv2.2       ------------------------------------------------LSFG 120
Kv3.1       ---------------------------------------------DSF------GGA 125
```

Figure 15U

```
Kv3.2       ------------------------------------------------DIFETPDLIGG 177
Kv3.3       ------------------------------------------------DSFEAPDPAGA 210
Kv3.4       ------------------------------------------------DIFE--SPDGG 167
Kv4.1       ------------------------------------------------YGLVPELVGDC 131
Kv4.2       ------------------------------------------------FGLIPEIIGDC 132
Kv4.3       ------------------------------------------------YGILPEIIGDC 131
Kv5.1       ------------------------------------------------
Kv6.1       ---------------------------------------------------EFA 177
Kv6.2       ---------------------------------------------------EAA 131
Kv6.3       ---------------------------------------------------
Kv6.4       ---------------------------------------------------ELE 173
Kv7.1       -----------------------------------------------------Q 147
Kv7.2       -----------------------------------------------------V 225
Kv7.3       -----------------------------------------------------I 254
Kv7.4       -----------------------------------------------------V 231
Kv7.5       -----------------------------------------------------V 259
Kv8.1       -----------------------------------------------------Q 138
Kv8.2       -----------------------------------------------------L 171
Kv9.1       ---------------------------------------------------PRA 166
Kv9.2       ---------------------------------------------------EQE 133
Kv9.3       ---------------------------------------------------EQE 133
Kv10.1      -----------------------------------------------------N 238
Kv10.2      -----------------------------------------------------N 235
Kv11.1      -----------------------------------------------------P 426
Kv11.2      -----------------------------------------------------P 275
Kv11.3      -----------------------------------------------------P 426
Kv12.1      -----------------------------------------------------F 233
Kv12.2      -----------------------------------------------------L 236
Kv12.3      -----------------------------------------------------F 238
HCN1        -----------------------------------------------------R 276
HCN2        -----------------------------------------------------R 345
HCN3        -----------------------------------------------------R 229
HCN4        -----------------------------------------------------R 396
CatSper1    ----------------------------------------------------GE 157
CatSper2    ----------------------------------------------------WN 178
CatSper3    ---------------------------------------------------INY 109
CatSper4    ---------------------------------------------------THM 83
Hv1         ------------------------------------------------
KCa1.1      ---------------------------------------------STWLTAAGFI 318
KCa4.1      --------------------------------------------------DQDL 442
KCa4.2      --------------------------------------------------DQDL 370
TPC1        ----------------------------------------------VVLVRQMS 268

Shaker      PLDVFSEEIKFYELGDQAINKFRE------------------------------DEG 195
Nav1.1      FMAMEHYPMTDHFNNVLTVGNLVFTGIFTAEMFLKIIAMDPYYYFQEGWNIFDGFIVTLS 843
Nav1.2      FMAMEHYPMTEQFSSVLSVGNLVFTGIFTAEMFLKIIAMDPYYYFQEGWNIFDGFIVSLS 834
Nav1.3      FMAMEHYPMTEQFSSVLTVGNLVFTGIFTAEMVLKIIAMDPYYYFQEGWNIFDGIIVSLS 835
Nav1.4      FMAMEHYPMTEHFDNVLTVGNLVFTGIFTAEMVLKLIAMDPYEYFQQGWNIFDSIIVTLS 653
Nav1.5      FMALEHYNMTSEFEEMLQVGNLVFTGIFTAEMTFKIIALDPYYYFQQGWNIFDSIIVILS 792
Nav1.6      FMAMEHHPMTPQFEHVLAVGNLVFTGIFTAEMFLKLIAMDPYYYFQEGWNIFDGFIVSLS 828
Nav1.7      FMAMEHHPMTEEFKNVLAIGNLVFTGIFAAEMVLKLIAMDPYEYFQVGWNIFDSLIVTLS 808
Nav1.8      FMAMEHHGMSPTFEAMLQIGNIVFTIFFTAEMVFKIIAFDPYYYFQKKWNIFDCIIVTVS 740
Nav1.9      FLAMEHHKMEASFEKMLNIGNLVFTSIFIAEMCLKIIALDPYHYFRRGWNIFDSIVALLS 652
Cav1.1      MYGLGLRQYFMSIFNRFDCFVVCSGILEI-----------------------LLVE 515
Cav1.2      MYSLGLQAYFVSLFNRFDCFVVCGGILET-----------------------ILVE 578
Cav1.3      MYSLGLQAYFVSLFNRFDCFVVCGGITET-----------------------ILVE 606
Cav1.4      LYGLGPSAYVSSFFNRFDCFVVCGGILET-----------------------TLVE 601
Cav2.1      MYGLGTRFYFHSSFNCFDCGVIIGSIFEV-----------------------IWAV 570
Cav2.2      MYGLGPRSYFRSSFNCFDFGVIVGSVFEV-----------------------VWAA 565
Cav2.3      MYGMGPRLYFHSSFNCFDFGVTVGSIFEV-----------------------VWAI 559
Cav3.1      MFDSDSEAVYEFTQDAQHSDLRDPHS-----------------RRQRSLGPDAEPSSVLA 727
Cav3.2      SGDSDGRGVYEFTQDVRHGDRWDPTRPRATDTPGPGPGSFQRRAQQRAAPGEPGWMG-R 777
```

Figure 15V

```
Cav3.3      DGASSELGKEEEEEEQADGAVWL--------------------------------CG-D 589
Kv1.1       PLDMFSEEIKFYELGEEAMEKFRE-------------------------------DEG 135
Kv1.2       PLDIFSEEIRFYELGEEAMEMFRE-------------------------------DEG 131
Kv1.3       PIDIFSEEIRFYQLGEEAMEKFRE-------------------------------DEG 202
Kv1.4       PFDIFTEEVKFYQLGEEALLKFRE-------------------------------DEG 274
Kv1.5       SLDVFADEIRFYQLGDEAMERFRE-------------------------------DEG 218
Kv1.6       PLDIFLEEIRFYQLGDEALAAFRE-------------------------------DEG 139
Kv1.7       PLDVFLEEVAFYGLGAAALARLRE-------------------------------DEG 111
Kv1.8       PIDIFADEISFYELGSEAMDQFRE-------------------------------DEG 184
Kv2.1       QELDYWGIDEIYLESCCQA--------------------------------------- 135
Kv2.2       QELDYWGIDEIYLESCCQA--------------------------------------- 139
Kv3.1       PLDNSADDADADGPGD----SGDGEDELE----------------------MTKR 154
Kv3.2       DPGDDEDL-AAKRLGIEDAAGLGGP--------------------------------- 201
Kv3.3       ANAANAAGAHDGGLDDEAGAGGGGLDGAGGELKRL-----------------CFQDAGG 252
Kv3.4       GSGAGPSDEAGDDERELALQRLGP--------------------------------HEG 194
Kv4.1       CLEEYRDRKKENAERLAEDEEAEQ--------------------------------- 155
Kv4.2       CYEEYKDRRRENAERLQDD--------------------------------------- 151
Kv4.3       CYEEYKDRKRENAERLMDD--------------------------------------- 150
Kv5.1       IARRVQLILDDLGVDAAEGRWRRCQ--------------------------------- 165
Kv6.1       EMVEREEEDDALDSEG--RDSEGP--------------------------------- 199
Kv6.2       EARAGPTERGAQGSPA--RAL------------------------------------- 150
Kv6.3       RMSDTYTFYSADEPGVLGRDEARP--------------------------------- 142
Kv6.4       ELA-KLHREDVLRQQR--ETR-RP--------------------------------- 193
Kv7.1       YAALATGTLFWMEIVLVVFFGTE----------------------------------- 170
Kv7.2       YAHSKELV------TAWYIGFLCLI--------------------------------- 244
Kv7.3       CAHSKELI------TAWYIGFLTLI--------------------------------- 273
Kv7.4       YAHSKELI------TAWYIGFLVLI--------------------------------- 250
Kv7.5       YAHSKELI------TAWYIGFLVLI--------------------------------- 278
Kv8.1       YWGIDELSIDSCCRDRYFRRKELSETL------------------------------- 165
Kv8.2       VLDGLCPRRFLEELGYWGVRLKYTP--------------------------------- 196
Kv9.1       WDEDSDTPSSVDPCPDEISDVQRE---------------------------------- 190
Kv9.2       KWDEQSDQESTTSSFDEILAFYN----------------------------------- 156
Kv9.3       KWDEQSDQESTTSSFDEILAFYN----------------------------------- 156
Kv10.1      VSFKTRQN------NVAWLVVDSI----------------------------------- 256
Kv10.2      VSFKTKQN------NIAWLVLDSV----------------------------------- 253
Kv11.1      YSAAFLLKETEEGPPATECGYACQPL-------------------------------- 452
Kv11.2      YSAAFLLS-DQDESRRGACSYTCSPL-------------------------------- 300
Kv11.3      YSAAFLLN-DREEQKRRECGYSCSPL-------------------------------- 451
Kv12.1      YVAVTVPY-NVCFIGNDDLSTTRSTT-------------------------------- 258
Kv12.2      YVAVTVPY-SVCVSTAREPSAARGPP-------------------------------- 261
Kv12.3      YVAVTVPY-NVCFSGDEDTPITSRHT-------------------------------- 263
HCN1        YIHQWEEI------FHMTYDLAS------------------------------------ 293
HCN2        YIHQWEEI------FHMTYDLAS------------------------------------ 362
HCN3        YIHQWEEI------FHMTYDLAS------------------------------------ 246
HCN4        YIHQWEEI------FHMTYDLAS------------------------------------ 413
CatSper1    NLSHYSSGVPHHGEASHRGGSYLPH--------------------------------- 182
CatSper2    VFDFVVTMLSLLPEVVVLVGVTGQ---------------------------------- 202
CatSper3    WKNGYNLLDVIIIVMFLPYALRQL---------------------------------- 134
CatSper4    YIKQLLRHPAFQLLLALLLVINAITI-------------------------------- 109
Hv1         AAAPDVAPAPGPAPRAPLDFRGML----------------------------------- 92
KCa1.1      HLVENSGDPWENFQNNQALTYWECVYLL------------------------------- 346
KCa4.1      MRAKM-----------DNGEACFIL---------------------------------- 456
KCa4.2      LRAKM-----------DDAEACFIL---------------------------------- 384
TPC1        HVRVTRALRCIFLVDCRYCGGVRRNLRQIFQ--------------------------- 299

Shaker      FI------KEEEERPLPD----------------NEKQRKVWLLFEYPESSQAAR------- 227
Nav1.1      LVELGLANVEGLSVLR----------SFRLLRVFKLAKSWPTLNMLIKIIGNS------ 886
Nav1.2      LMELGLANVEGLSVLR----------SFRLLRVFKLAKSWPTLNMLIKIIGNS------ 877
Nav1.3      LMELGLSNVEGLSVLR----------SFRLLRVFKLAKSWPTLNMLIKIIGNS------ 878
Nav1.4      LVELGLANVQGLSVLR----------SFRLLRVFKLAKSWPTLNMLIKIIGNS------ 696
Nav1.5      LMELGLSRMSNLSVLR----------SFRLLRVFKLAKSWPTLNTLIKIIGNS------ 835
Nav1.6      LMELSLADVEGLSVLR----------SFRLLRVFKLAKSWPTLNMLIKIIGNS------ 871
Nav1.7      LVELFLADVEGLSVLR----------SFRLLRVFKLAKSWPTLNMLIKIIGNS------ 851
```

Figure 15W

```
Nav1.8      LLELGVAKKGSLSVLR----------SFPLLRVFKLAKSWPTLNTLIKIIGNS------ 783
Nav1.9      FA--DVMNCVLQKRSWPFLR-------SFPVLRVFKLAKSWPTLNTLIKIIGNS------ 697
Cav1.1      SGAMTPLGISVLRCIRLL---------RIFKITKYWTSLSNLVASLLNSIRSIASLLLLL 566
Cav1.2      TKIMSPLGISVLRCVRLL---------RIFKITRYWNSLSNLVASLLNSVRSIASLLLLL 629
Cav1.3      LEIMSPLGISVFRCVRLL---------RIFKVTRHWTSLCNLVASLLNSMKSSASLLLLL 657
Cav1.4      VGAMQPLGISVLRCVRLL---------RIFKVTRHWASLSNLVASLLNSMKSIASLLLLL 652
Cav2.1      IKPGTSFGISVLRALPLL---------RIFKVTKYWASLRNLVVSLLNSMKSIISLLFLL 621
Cav2.2      IKPGSSFGISVLRALPLL---------RIFKVTKYWSSLRNLVVSLLNSMKSIISLLFLL 616
Cav2.3      FRPGTSFGISVLRALPLL---------RIFKITKYWASLRNLVVSLMSSMKSIISLLFLL 610
Cav3.1      FWRLICDTFRKIVDSK-----------------YFGRGIMIAILVNTLSMGIEYHEQPEEL 771
Cav3.2      LWVTFSGKLRRIVDSK-----------------YFSRGIMMAILVNTLSMGVEYHEQPEEL 821
Cav3.3      VWRETRAKLRGIVDSK-----------------YFNRGIMMAILVNTVSMGIEHHEQPEEL 633
Kv1.1       FI-----KEEERPLPE-----------------KEYQRQVWLLFEYPESSGPAR------ 167
Kv1.2       YI-----KEEERPLPE-----------------NEFQRQVWLLFEYPESSGPAR------ 163
Kv1.3       FL-----REEERPLPR-----------------RDFQRQVWLLFEYPESSGPAR------ 234
Kv1.4       FV-----REEEDRALP-----------------ENEFKKQIWLLFEYPESSSPAR------ 307
Kv1.5       FI-----KEEEKPLPR-----------------NEFQRQVWLIFEYPESSGSAR------ 250
Kv1.6       CLPE--GGEDEKPLPS-----------------QPFQRQVWLLFEYPESSGPAR------ 174
Kv1.7       CP-----VPPERPLPR-----------------RAFARQLWLLFEFPESSQAAR------ 143
Kv1.8       FI-----KDPETLLPT-----------------NDIHRQFWLLFEYPESSSAAR------ 216
Kv2.1       ------------RYH------------------QKKEQMNEEL------KREAET----- 154
Kv2.2       ------------RYH------------------QKKEQMNEEL------RREAET----- 158
Kv3.1       LALS--DSPDGRPGGF-----------------WRRWQPRIWALFEDPYSSRYAR------ 190
Kv3.2       ----------DGKSGR-----------------WRRLQPRMWALFEDPYSSRAAR------ 229
Kv3.3       GAGGPPGGAGGAGGTW-----------------WRRWQPRVWALFEDPYSSRAAR------ 290
Kv3.4       GAGH------GAGSGG-----------------CRGWQPRMWALFEDPYSSRAAR------ 226
Kv4.1       ------------AGD------------------GPALPAGSS-------LRQRLW------ 173
Kv4.2       ------------ADT------------------DTAGESALP-------TMTARQ------ 169
Kv4.3       ------------NDS------------------ENNQESMPS-------LSFRQT------ 168
Kv5.1       ------------KCVW-----------------------------KFLEKPESSCPARV-- 183
Kv6.1       ----------AEGEGR-----------------LG----RCM-------RRLRDM------ 216
Kv6.2       ----------GPRGR------------------LQ----RGR-------RRLRDV------ 166
Kv6.3       ----------GGAEA------------------APSRRWLERMRRTFEEPTSSLAAQIL---- 173
Kv6.4       ----------ASHSSR-----------------WG----LCM-------NRLREM------ 210
Kv7.1       ----------YVVRL------------------WSAGCRSK-------YVGLWGRL----- 191
Kv7.2       ----------LASF-------------------LVYLA--EK-------GE--ND------ 259
Kv7.3       ----------LSSF-------------------LVYLV--EK-------DVPEVD------ 290
Kv7.4       ----------FASF-------------------LVYLA--EK-------DA--NS------ 265
Kv7.5       ----------FSSF-------------------LVYLV--EK-------DA--NK------ 293
Kv8.1       ------------DFK------------------KDTEDQESQ-------HESEQDF----- 184
Kv8.2       ----------RCCRICF----------------EERRDELSERLKIQHELRAQAQVEE---- 228
Kv9.1       ----------LARYGA-----------------ARC--GRLR-------RRLWLT------ 209
Kv9.2       ----------DASKF------------------DGQPLGNPR-------RQLWLA------ 176
Kv9.3       ----------DASKF------------------DGQPLGNFR-------RQLWLA------ 176
Kv10.1      ------------VDVI-----------------FLV-------------DIVLNF------ 269
Kv10.2      ------------VDVI-----------------FLV-------------DIVLNF------ 266
Kv11.1      ------------AVVD-----------------LIVDIMFIV-------DILINF------ 471
Kv11.2      ------------TVVD-----------------LIVDIMFVV-------DIVINF------ 319
Kv11.3      ------------NVVD-----------------LIVDIMFII-------DILINF------ 470
Kv12.1      ------------VSD------------------IAVEILFII-------DIILNF------ 276
Kv12.2      ------------SVCD-----------------LAVEVLFIL-------DIVLNF------ 280
Kv12.3      ------------LVSD-----------------IAVEMLFIL-------DIILNF------ 282
HCN1        ------------AVVR-----------------IFNLI--GM-------MLLLCH------ 310
HCN2        ------------AVMR-----------------ICNLI--SM-------MLLLCH------ 379
HCN3        ------------AVVR-----------------IFNLI--GM-------MLLLCH------ 263
HCN4        ------------AVVR-----------------IVNLI--GM-------MLLLCH------ 430
CatSper1    ----------GPNPYSE----------------SFHHSEASHL------SGLQHDE----- 206
CatSper2    ------------SVWLQL---------------LRICRVLRSLKLLAQFRQIQIIIL---- 232
CatSper3    ------------MGKQF----------------------------TYLYIAD------ 146
CatSper4    ------------ALR------------------TNSYLDQKHYELFSTIDDIVLTILL--- 137
Hv1         ---------------------------------------------RKLFSS------ 98
KCa1.1      -----------MVT-------------------MSTVGYGDVYAKTTLGRLFMVFFIL--- 374
KCa4.1      -----------SSR-------------------NEVDRTAAD--HQTILRAWAVK------ 479
KCa4.2      -----------SSR-------------------CEVDRTSSD--HQTILRAWAVK------ 407
TPC1        ----------SLPPFMDILLLLLFFMIIFAILGFYLFSPNPSDPYFSTLENSIVSLFVLLT- 350
```

Figure 15X

```
Shaker    ---------VVA----------------------------IISVF-VILLS 240
Nav1.1    ---------VGALGNLT----------------------LVLAIIVFIFAVVGMQLFGKS 915
Nav1.2    ---------VGALGNLT----------------------LVLAIIVFIFAVVGMQLFGKS 906
Nav1.3    ---------VGALGNLT----------------------LVLAIIVFIFAVVGMQLFGKS 907
Nav1.4    ---------VGALGNLT----------------------LVLAIIVFIFAVVGMQLFGKS 725
Nav1.5    ---------VGALGNLT----------------------LVLAIIVFIFAVVGMQLFGKN 864
Nav1.6    ---------VGALGNLT----------------------LVLAIIVFIFAVVGMQLFGKS 900
Nav1.7    ---------VGALGNLT----------------------LVLAIIVFIFAVVGMQLFGKS 880
Nav1.8    ---------VGALGNLT----------------------IILAIIVFVFALVGKQLLGEN 812
Nav1.9    ---------VGALGSLT----------------------VVLVIVIFIFSVVGMQLFGRS 726
Cav1.1    FLPIVIFRLLGMQLFGGRYDFEDTEVRPSNFDNFPQALISVFQVLTGEDWTSMMYNGIMA 626
Cav1.2    FLFIIIFSLLGMQLFGGKFNFDEMQTRPSTFDNFPQSLLTVFQILTGEDWNSVMYDGIMA 689
Cav1.3    FLFIIIFSLLGMQLFGGKFNFDETQTKRSTFDNFPQALLTVFQILTGEDWNAVMYDGIMA 717
Cav1.4    FLFIIIFSLLGMQLFGGKFNFDQTHTKRSTFDTFPQALLTVFQILTGEDWNVVMYDGIMA 712
Cav2.1    FLFIVVFALLGMQLFGGQFNFD-EGTPPTNFDTFPAAIMTVFQILTGEDWNEVMYDGIKS 680
Cav2.2    FLFIVVFALLGMQLFGGQFNFQ-DETPTTNFDTFPAAILTVFQILTGEDWNAVMYHGIES 675
Cav2.3    FLFIVVFALLGMQLFGGRFNFN-DGTPSANFDTFPAAIMTVFQILTGEDWNEVMYNGIPS 669
Cav3.1    TNALEISNIVFTSLFALEMLLKLLVYGPFGYIKNPYNIFDGVIVVISVWEIVGQQGGGLS 831
Cav3.2    TNALEISNIVFTSMFALEMLLKLLACGPLGYIRNPYNIFDGIIVVISVWEIVGQADGGLS 881
Cav3.3    TNILEICNVVFTSMFALEMILKLAAFGLFDYLRNPYNIFDSIIVIISIWEIVGQADGGLS 693
Kv1.1     ---------VIA---------------------------IVSVM-VILIS 180
Kv1.2     ---------IIA---------------------------IVSVM-VILIS 176
Kv1.3     ---------GIA---------------------------IVSVL-VILIS 247
Kv1.4     ---------GIA---------------------------IVSVL-VILIS 320
Kv1.5     ---------AIA---------------------------IVSVL-VILIS 263
Kv1.6     ---------GIA---------------------------IVSVL-VILIS 187
Kv1.7     ---------VLA---------------------------VVSVL-VILVS 156
Kv1.8     ---------AVA---------------------------VVSVL-VVVIS 229
Kv2.1     ---------LPE---------------------------REGEEFDNTCC 168
Kv2.2     ---------MPE---------------------------REGEEFDNTCC 172
Kv3.1     ---------YVA---------------------------FASLF-FILVS 203
Kv3.2     ---------FIA---------------------------FASLF-FILVS 242
Kv3.3     ---------YVA---------------------------FASLF-FILIS 303
Kv3.4     ---------VVA---------------------------FASLF-FILVS 239
Kv4.1     ---------RAF---------------------------E---NPHTSTA 184
Kv4.2     ---------RVW---------------------------RAFENPHTSTM 183
Kv4.3     ---------MWR---------------------------AFE-NPHTSTL 181
Kv5.1     ---------------------------------------VAVLSFLLILVS 195
Kv6.1     ---------VER---------------------------PHSGLPGK---V 228
Kv6.2     ---------VDN---------------------------PHSGLAGK---L 178
Kv6.3     ---------------------------------------ASVSVVFVIVS 184
Kv6.4     ---------VEN---------------------------PQSGLPGK---V 222
Kv7.1     ------RFARKPISII-----------------------DLIVVVASMVVLCVG 216
Kv7.2     ---------HFD---------------------------TYADALWWGLIT 274
Kv7.3     ------AQGEEM---------------------------KEEFETYADALWWGLIT 313
Kv7.4     ---------DFS---------------------------SYADSLWWGTIT 280
Kv7.5     ---------EFS---------------------------TYADALWWGTIT 308
Kv8.1     ---------------------------------------SQGPCPTVRQK 195
Kv8.2     ---------------------------------------AEELFRDMRFYGPQRR 244
Kv9.1     ---------MEN---------------------------PGYSLPSKLFS 223
Kv9.2     ---------LDN---------------------------PGYSVLSRVFS 190
Kv9.3     ---------LDN---------------------------PGYSVLSRVFS 190
Kv10.1    ---------HTTF--------------------------VGPAGEVISDPK 285
Kv10.2    ---------HTTF--------------------------VGPGGEVISDPK 282
Kv11.1    ---------RTTY--------------------------VNANEEVVSHPG 487
Kv11.2    ---------RTTY--------------------------VNTNDEVVSHPR 335
Kv11.3    ---------RTTY--------------------------VNQNEEVVSDPA 486
Kv12.1    ---------RTTY--------------------------VSKSGQVIFEAR 292
Kv12.2    ---------RTTF--------------------------VSKSGQVVFAPK 296
Kv12.3    ---------RTTY--------------------------VSQSGQVISAPR 298
HCN1      ---------WDGCLQFL----------------------VPLLQDFPPDCWVSLNE 335
HCN2      ---------WDGCLQFL----------------------VPMLQDFPRNCWVSING 404
HCN3      ---------WDGCLQFL----------------------VPMLQDFPPDCWVSINH 288
```

Figure 15Y

```
HCN4         ---------WDGCLQFL---------------------------VPMLQDFPDDCWVSINN  455
CatSper1     --------------------------------------------SQHRQVPHRGWP       218
CatSper2     ------------------------------------------------VLVRALKSMTF    243
CatSper3     -------------------------------------------------GMQSLRILK     155
CatSper4     -----------------------------------------------CEVLLGWLNGFWI   150
Hv1          ------------------------------------------------HRFQVIIIC      107
KCa1.1       ---GGLAMFASYVPEIIELI------------------------GNRKYGGSYSA        403
KCa4.1       --------DFAPNCPL----------------------------YVQILKPENKFHVKFAD  504
KCa4.2       --------DFAPNCPL----------------------------YVQILKPENKFHIKFAD  432
TPC1         ---------TANFP------------------------------DVMMPSYSRNPW       367

Shaker       IVIFCLETLPE---------FKHY---K-----------------------------      256
Nav1.1       -YKDCVCKIAS----DCQLP-RWH---MNDFFHSFLIVFRVLCGEWIE------------  954
Nav1.2       -YKECVCKISN----DCELP-RWH---MHDFFHSFLIVFRVLCGEWIE------------  945
Nav1.3       -YKECVCKIND----DCTLP-RWH---MNDFFHSFLIVFRVLCGEWIE------------  946
Nav1.4       -YKECVCKIAL----DCNLP-RWH---MHDFFHSFLIVFRILCGEWIE------------  764
Nav1.5       -YSELR---DS----DSGLLPRWH---MMDFFHAFLIIFRILCGEWIE------------  901
Nav1.6       -YKECVCKINQ----DCELP-RWH---MHDFFHSFLIVFRVLCGEWIE------------  939
Nav1.7       -YKECVCKIND----DCTLP-RWH---MNDFFHSFLIVFRVLCGEWIE------------  919
Nav1.8       -YRNNRKNISA----PHEDWPRWH---MHDFFHSFLIVFRILCGEWIE------------  852
Nav1.9       FNSQKSPKLCNPTGPTVSCLRHWH---MGDFWHSFLVVFRILCGEWIE------------  771
Cav1.1       SSGPSYPGMLVCIYFIILFVCGNYILLNVFLAIAVDNLAEAESLTSAQ------------  674
Cav1.2       YGGPSFPGMLVCIYFIILFICGNYILLNVFLAIAVDNLADAESLTSAQ------------  737
Cav1.3       YGGPSSSGMIVCIYFIILFICGNYILLNVFLAIAVDNLADAESLNTAQ------------  765
Cav1.4       YGGPFFPGMLVCIYFIILFICGNYILLNVFLAIAVDNLAS--------------------  752
Cav2.1       QGG-VQGGMVFSIYFIVLTLFGNYTLLNVFLAIAVDNLANAQELTKVEADEQEEEEAANQ  739
Cav2.2       QGG-VSKGMFSSFYFIVLTLFGNYTLLNVFLAIAVDNLANAQELTKDEEEM---EEAANQ  731
Cav2.3       QGG-VSSGMWSAIYFIVLTLFGNYTLLNVFLAIAVDNLANAQELTKDEQEE---EEAPNQ  725
Cav3.1       VLRTFRLMRVLKLVRFLPALQRQL---VVLMKTMDNVATFCMLLMLFIFIFSI-------  881
Cav3.2       VLRTFRLLRVLKLVRFLPALRRQL---VVLVKTMDNVATFCTLLMLFIFIFSI-------  931
Cav3.3       VLRTFRLLRVLKLVRFMPALRRQL---VVLMKTMDNVATFCMLLMLFIFIFSI-------  743
Kv1.1        IVIFCLETLPE---------LKDD---KDF-----------------------------  198
Kv1.2        IVSFCLETLPI---------FRDE---NE------------------------------  193
Kv1.3        IVIFCLETLPE---------FRDE---KDY-----------------------------  265
Kv1.4        IVIFCLETLPE---------FRDD---RDL-----------------------------  338
Kv1.5        IITFCLETLPE---------FRDE---REL-----------------------------  281
Kv1.6        IVIFCLETLPQ---------FRVD---GRG-----------------------------  205
Kv1.7        IVVFCLETL-----------PDFR---DDR-----------------------------  172
Kv1.8        ITIFCLETLPE---------FRED---REL-----------------------------  247
Kv2.1        AEKRKKLWDLL---------EKPN---SSV-----------------------------  186
Kv2.2        PDKRKKLWDLL---------EKPN---SSV-----------------------------  190
Kv3.1        ITTFCLETHER---------FNPI---VNK-----------------------------  221
Kv3.2        ITTFCLETHEA---------FNIV---KNK-----------------------------  260
Kv3.3        ITTFCLETHEG---------FIHI---SNK-----------------------------  321
Kv3.4        ITTFCLETHEA---------FNID---RNV-----------------------------  257
Kv4.1        ALVFYYVTGFF---------IAVS---VIA-----------------------------  202
Kv4.2        ALVFYYVTGFF---------IAVS---VIA-----------------------------  201
Kv4.3        ALVFYYVTGFF---------IAVS---VIT-----------------------------  199
Kv5.1        SVVMCMGTIPELQ----------------------------------------------  208
Kv6.1        FACLS---------------VLF----VTV-----------------------------  239
Kv6.2        FACVS---------------VSF----VAV-----------------------------  189
Kv6.3        MVVLCASTLPD------------------------------------------------  195
Kv6.4        FACLS---------------ILF----VAT-----------------------------  233
Kv7.1        SKGQVFATSAIRGI--------RFLQILRML----------------------------  239
Kv7.2        LTTIGYGDKYPQTWN-------GRLL----AATFTLIGVSFFALPAG------------  310
Kv7.3        LATIGYGDKTPKTWE-------GRLI----AATFSLIGVSFFALPAG------------  349
Kv7.4        LTTIGYGDKTPHTWL-------GRVL----AAGFALLGISFFALPAG------------  316
Kv7.5        LTTIGYGDKTPLTWL-------GRLL----SAGFALLGISFFALPAG------------  344
Kv8.1        LWNILEKP--------------GSS----------------------------------  206
Kv8.2        RLWNLMEKPFS-----------SVAAKAIGV----------------------------  264
Kv9.1        CVSIS-----------------VVL---ASI----------------------------  234
Kv9.2        ILSIL-----------------VVM---GSI----------------------------  201
Kv9.3        VLSIL-----------------VVL---GSI----------------------------  201
```

Figure 15Z

```
Kv10.1      LIRMNYLKTWFVIDLLSCLPYDVI---NAFENVDEVSAFMGDPGKIGFADQIP-------  335
Kv10.2      LIRMNYLKTWFVIDLLSCLPYDII---NAFENVDEGI------------------------  316
Kv11.1      RIAVHYFKGWFLID--MVA--AIF---FDLLIFGSGSEEL---------------------  520
Kv11.2      RIAVHYFKGWFLID--MVA--AIF---FDLLIFRTGSDET---------------------  368
Kv11.3      KIAIHYFKGWFLID--MVA--AIF---FDLLIFGSGSDET---------------------  519
Kv12.1      SICIHYVTTWFIID--LIA--ALF---FDLLYAFNVTV----------------------  323
Kv12.2      SICLHYVTTWFLLD--VIA--ALF---FDLLHAFKVNV----------------------  327
Kv12.3      SIGLHYLATWFFID--LIA--ALF---FDLLYIFNITV----------------------  329
HCN1        MVNDSWGKQYSYALF-----KAMS---HMLC--IGYGAQA--------------------  365
HCN2        MVNHSWSELYSFALF-----KAMS---HMLC--IGYGRQA--------------------  434
HCN3        MVNHSWGRQYSHALF-----KAMS---HMLC--IGYGQQA--------------------  318
HCN4        MVNNSWGKQYSYALF-----KAMS---HMLC--IGYGRQA--------------------  485
CatSper1    RRHQVHHHGRS---------RHH--EAHQ-------------------------------  236
CatSper2    LLMLLLIFFYI---------------FAVT------------------------------  258
CatSper3    LIGYSQGIRTLI-------------------------------------------------  167
CatSper4    FWKDGWNILNFII--------VFILLLRFFI-----------------------------  173
Hv1         LVVLD--------------------------------------------------------  112
KCa1.1      VSGRKHIVVCGHITL-----ESVSNFLKDFLRKDR-------------------------  433
KCa4.1      HVVCEEECKY----------------AMLALNCICPAT---------------------  526
KCa4.2      HVVCEEEFKY----------------AMLALNCICPAT---------------------  454
TPC1        SCVFFIVYLSIELYFIMNLLAVVFDTFNDIEKRKFKSLLL--------------------  408

Shaker      ------------------------------------------------------------
Nav1.1      ---------------------TMWDC---------------------------------  959
Nav1.2      ---------------------TMWDC---------------------------------  950
Nav1.3      ---------------------TMWDC---------------------------------  951
Nav1.4      ---------------------TMWDC---------------------------------  769
Nav1.5      ---------------------TMWDC---------------------------------  906
Nav1.6      ---------------------TMWDC---------------------------------  944
Nav1.7      ---------------------TMWDC---------------------------------  924
Nav1.8      ---------------------NMWAC---------------------------------  857
Nav1.9      ---------------------NMWEC---------------------------------  776
Cav1.1      ----------------KAKAEEKKRRK---------------------------------  685
Cav1.2      ----------------KEEEEEKERKKL--------------------------------  749
Cav1.3      ----------------KEEAEEKERKKI--------------------------------  777
Cav1.4      -------------------GDAGT-----------------------------------  757
Cav2.1      KLALQKAKEVAEVSPLSAANM-SIAVKEQQKNQKPAKSVWEQRTSEMRKQNLLASREALY  798
Cav2.2      KLALQKAKEVAEVSPMSAANI-SIAARQQNSAK--ARSVWEQRASQLRLQNLRASCEALY  788
Cav2.3      KHALQKAKEVSPMSAPNMPSIERERRR---RH---HMSVWEQRTSQLRKHMQMSSQEALN  779
Cav3.1      ----LGMHLFGCKFA-SERDGDTLPDRK--------------------------------  904
Cav3.2      ----LGMHLFGCKFSLKTDTGDTVPDRK--------------------------------  955
Cav3.3      ----LGMHIFGCKFSLRTDTGDTVPDRK--------------------------------  767
Kv1.1       -----------------------TG----------------------------------  200
Kv1.2       -----------------------DM----------------------------------  195
Kv1.3       ---------------------PASTS---------------------------------  270
Kv1.4       ---------------------VMALS---------------------------------  343
Kv1.5       ---------------------LRHPP---------------------------------  286
Kv1.6       ---------------------GNNGG---------------------------------  210
Kv1.7       ---------------------DGTGL---------------------------------  177
Kv1.8       ------------------------KV---------------------------------  249
Kv2.1       --------------------AAKIL----------------------------------  191
Kv2.2       --------------------AAKIL----------------------------------  195
Kv3.1       ---------------------TEIEN---------------------------------  226
Kv3.2       ---------------------TEPVI---------------------------------  265
Kv3.3       ---------------------TVTQA---------------------------------  326
Kv3.4       ---------------------TEILR---------------------------------  262
Kv4.1       ---------------------NVVET---------------------------------  207
Kv4.2       ---------------------NVVET---------------------------------  206
Kv4.3       ---------------------NVVET---------------------------------  204
```

Figure 15AA

```
Kv5.1     ------------------------------------------------------------
Kv6.1     ------------------------TAVNL------------------------------- 244
Kv6.2     ------------------------TAVGL------------------------------- 194
Kv6.3     ------------------------WPNA-------------------------------- 199
Kv6.4     ------------------------TAVSL------------------------------- 238
Kv7.1     ------------------------HVDRQ------------------------------- 244
Kv7.2     ------------------------ILGSGF------------------------------ 316
Kv7.3     ------------------------ILGSGL------------------------------ 355
Kv7.4     ------------------------ILGSGF------------------------------ 322
Kv7.5     ------------------------ILGSGF------------------------------ 350
Kv8.1     ------------------------TAARIF------------------------------ 212
Kv8.2     ------------------------ASSTF------------------------------- 269
Kv9.1     ------------------------AAMCI------------------------------- 239
Kv9.2     ------------------------ITMCL------------------------------- 206
Kv9.3     ------------------------ITMCL------------------------------- 206
Kv10.1    -----PPLEGRESQGISSLFSSLKVVRLL------------------------------- 359
Kv10.2    ----------------SSLFSSLKVVRLL------------------------------- 329
Kv11.1    ----------------I---GLLKTARLL------------------------------- 530
Kv11.2    ----------------TTLIGLLKTARLL------------------------------- 381
Kv11.3    ----------------TTLIGLLKTARLL------------------------------- 532
Kv12.1    ----------------VSLVHLLKTVRLL------------------------------- 336
Kv12.2    ----------------YFGAHLLKTVRLL------------------------------- 340
Kv12.3    ----------------TSLVHLLKTVRLL------------------------------- 342
HCN1      ------------------------PVSMS------------------------------- 370
HCN2      ------------------------PESMT------------------------------- 439
HCN3      ------------------------PVGMP------------------------------- 323
HCN4      ------------------------PVGMS------------------------------- 490
CatSper1  ------------------------HGKSP------------------------------- 241
CatSper2  ------------------------GVYVF------------------------------- 263
CatSper3  ------------------------TAVGQ------------------------------- 172
CatSper4  ------------------------NEINIP------------------------------ 179
Hv1       ------------------------------------------------------------
KCa1.1    ------------------------DDVN-------------------------------- 437
KCa4.1    ------------STLI--TLLVHTSRGQE------------------------------- 541
KCa4.2    ------------STLI--TLLVHTSRGQE------------------------------- 469
TPC1      ------------------------HKPTA------------------------------- 413

Shaker    ------------------------------------------------------------
Nav1.1    ------------------------MEVAGQAMCLTVFMMVM------------------- 976
Nav1.2    ------------------------MEVAGQTMCLTVFMMVM------------------- 967
Nav1.3    ------------------------MEVAGQTMCLIVFMLVM------------------- 968
Nav1.4    ------------------------MEVAGQAMCLTVFLMVM------------------- 786
Nav1.5    ------------------------MEVSGQSLCLLVFLLVM------------------- 923
Nav1.6    ------------------------MEVAGQAMCLIVFMMVM------------------- 961
Nav1.7    ------------------------MEVAGQAMCLIVYMMVM------------------- 941
Nav1.8    ------------------------MEVGQKSICLILFLTVM------------------- 874
Nav1.9    ------------------------MQEANASSSLCVIVFILI------------------ 794
Cav1.1    ------------------------MSKGLPDKSEE------------------------- 696
Cav1.2    ------------------------ARTASPEKKQELVE---------------------- 763
Cav1.3    ------------------------ARKESLENK--------------------------- 786
Cav1.4    ------------------------AKDKGGEKS--------------------------- 766
Cav2.1    NEMDPDERWKAAYTRHLRPDMKTHLDRPLVVDPQENRNNNTNKSRAAEPTVDQRLGQQRA 858
Cav2.2    SEMDPEERLRFATTRHLRPDMKTHLDRPLVVELGRDGARGPVGGKARPE-AAEAP---EGV 845
Cav2.3    REEAPT-----------MNPLNPLNPLSSLNPLNAHPSLYRPPRAIEGLALGLALEKF 826
Cav3.1    ------------------------NFDSLLWAIVTVFQILTQ------------------ 922
Cav3.2    ------------------------NFDSLLWAIVTVFQILTQ------------------ 973
Cav3.3    ------------------------NFDSLLWAIVTVFQILTQ------------------ 785
Kv1.1     ------------------------TVH--------------------------------- 203
Kv1.2     ------------------------HGS--------------------------------- 198
Kv1.3     ------------------------QDSFE------------------------------- 275
Kv1.4     ------------------------AGGHG------------------------------- 348
```

Figure 15AB

```
Kv1.5      --------------------------------APHQPPAPAPG--------------- 297
Kv1.6      --------------------------------VSRVSPVSRGSQEEEED--------- 227
Kv1.7      --------------------------------AAAA--------------------- 181
Kv1.8      --------------------------------VRDPNL------------------- 255
Kv2.1      --------------------------------AIISIMFI----------------- 199
Kv2.2      --------------------------------AIVSILFI----------------- 203
Kv3.1      --------------------------------V------------------------ 227
Kv3.2      --------------------------------NGTS--------------------- 269
Kv3.3      --------------------------------SPIP--------------------- 330
Kv3.4      --------------------------------V------------------------ 263
Kv4.1      --------------------------------IPCRGSAR----------------- 215
Kv4.2      --------------------------------VPCGSSPG----------------- 214
Kv4.3      --------------------------------VPCGTVPG----------------- 212
Kv5.1      ---------------------------------------------------------
Kv6.1      --------------------------------SVST-------------L-------- 249
Kv6.2      --------------------------------CLST-------------M-------- 199
Kv6.3      ---------------------------------------------------------
Kv6.4      --------------------------------CVST-------------M-------- 243
Kv7.1      --------------------------------GGTWRL------------------- 250
Kv7.2      --------------------------------ALKVQEQH----------------- 324
Kv7.3      --------------------------------ALKVQEQH----------------- 363
Kv7.4      --------------------------------ALKVQEQH----------------- 330
Kv7.5      --------------------------------ALKVQEQH----------------- 358
Kv8.1      ---------------------------------------------------------
Kv8.2      --------------------------------VLVSVVAL----------------- 277
Kv9.1      --------------------------------HSLPEYQA----REAAA-------- 252
Kv9.2      --------------------------------NSLP--------DFQIP-------- 215
Kv9.3      --------------------------------NSLP--------DFQIP-------- 215
Kv10.1     --------------------------------RLGRVARK----------------- 367
Kv10.2     --------------------------------RLGRVARK----------------- 337
Kv11.1     --------------------------------RLVRVARK----------------- 538
Kv11.2     --------------------------------RLVRVARK----------------- 389
Kv11.3     --------------------------------RLVRVARK----------------- 540
Kv12.1     --------------------------------RLLRLLQK----------------- 344
Kv12.2     --------------------------------RLLRLLPR----------------- 348
Kv12.3     --------------------------------RLLRLLQK----------------- 350
HCN1       --------------------------------DLWI---T----------------- 375
HCN2       --------------------------------DIWL---T----------------- 444
HCN3       --------------------------------DVWL---T----------------- 328
HCN4       --------------------------------DVWL---T----------------- 495
CatSper1   --------------------------------HHGETISP----------------- 249
CatSper2   ---------------------------------------------------------
CatSper3   ---------------------------------------------------------
CatSper4   ---------------------------------------------------------
Hv1        ---------------------------------------------------------
KCa1.1     --------------------------------VEIVFLHNISPNLELEALF------ 456
KCa4.1     --------------------------------GQESPEQWQR--------------- 551
KCa4.2     --------------------------------GQQSPEQWQK--------------- 479
TPC1       --------------------------------IQHAYRLLISQRR------------ 426

Shaker     ---------------------------------------------------------
Nav1.1     ---------------------------------------------------------
Nav1.2     ---------------------------------------------------------
Nav1.3     ---------------------------------------------------------
Nav1.4     ---------------------------------------------------------
Nav1.5     ---------------------------------------------------------
Nav1.6     ---------------------------------------------------------
Nav1.7     ---------------------------------------------------------
Nav1.8     ---------------------------------------------------------
Nav1.9     ---------------------------------------------------------
Cav1.1     ---------EKSTMA----KKLEQKPKGEGIP------------------------- 715
Cav1.2     -----KPAVGESKEE----KIELKSIT------------------------------ 781
Cav1.3     ---------KNNKPE----VNQIANSD------------------------------ 800
```

Figure 15AC

```
Cav1.4      ---------NEKDLPQENEGLVPGVEKEEEEG------------------------------ 789
Cav2.1      EDFLRKQARYHDRARDPSGSAGLDARRPWAGSQEAELSREGPYGRESDHHAREGSLEQPG 918
Cav2.2      -DPPRRHHRHRDKDKTPAAGDQDRAEAPKAES--GEPGA-REERPRPHRSHS-------K 894
Cav2.3      EEERISRGGSLKGDGG-DRSSALDNQR-TPLS-----LGQREPPWLARFCHG-------N 872
Cav3.1      ------------------------------------------------------------
Cav3.2      ------------------------------------------------------------
Cav3.3      ------------------------------------------------------------
Kv1.1       ------------------------------------------------------------
Kv1.2       ------------------------------------------------------------
Kv1.3       ------------------------------------------------------------
Kv1.4       ------------------------------------------------------------
Kv1.5       ------------------------------------------------------------
Kv1.6       ------------------------------------------------------------
Kv1.7       ------------------------------------------------------------
Kv1.8       ------------------------------------------------------------
Kv2.1       ------------------------------------------------------------
Kv2.2       ------------------------------------------------------------
Kv3.1       ------------------------------------------------------------
Kv3.2       ------------------------------------------------------------
Kv3.3       ------------------------------------------------------------
Kv3.4       ------------------------------------------------------------
Kv4.1       ------------------------------------------------------------
Kv4.2       ------------------------------------------------------------
Kv4.3       ------------------------------------------------------------
Kv5.1       ------------------------------------------------------------
Kv6.1       ------------------------------------------------------------
Kv6.2       ------------------------------------------------------------
Kv6.3       ------------------------------------------------------------
Kv6.4       ------------------------------------------------------------
Kv7.1       ------------------------------------------------------------
Kv7.2       ------------------------------------------------------------
Kv7.3       ------------------------------------------------------------
Kv7.4       ------------------------------------------------------------
Kv7.5       ------------------------------------------------------------
Kv8.1       ------------------------------------------------------------
Kv8.2       ------------------------------------------------------------
Kv9.1       ------------------------------------------------------------
Kv9.2       ------------------------------------------------------------
Kv9.3       ------------------------------------------------------------
Kv10.1      ------------------------------------------------------------
Kv10.2      ------------------------------------------------------------
Kv11.1      ------------------------------------------------------------
Kv11.2      ------------------------------------------------------------
Kv11.3      ------------------------------------------------------------
Kv12.1      ------------------------------------------------------------
Kv12.2      ------------------------------------------------------------
Kv12.3      ------------------------------------------------------------
HCN1        ------------------------------------------------------------
HCN2        ------------------------------------------------------------
HCN3        ------------------------------------------------------------
HCN4        ------------------------------------------------------------
CatSper1    ------------------------------------------------------------
CatSper2    ------------------------------------------------------------
CatSper3    ------------------------------------------------------------
CatSper4    ------------------------------------------------------------
Hv1         ------------------------------------------------------------
KCa1.1      ------------------------------------------------------------
KCa4.1      ------------------------------------------------------------
KCa4.2      ------------------------------------------------------------
TPC1        ------------------------------------------------------------
```

Figure 15AD

```
Shaker  ------------------------------------VFNTT---------- 261
Nav1.1  ------------------------------------VIGNLVVLNLFLALL 991
Nav1.2  ------------------------------------VIGNLVVLNLFLALL 982
Nav1.3  ------------------------------------VIGNLVVLNLFLALL 983
Nav1.4  ------------------------------------VIGNLVVLNLFLALL 801
Nav1.5  ------------------------------------VIGNLVVLNLFLALL 938
Nav1.6  ------------------------------------VIGNLVVLNLFLALL 976
Nav1.7  ------------------------------------VIGNLVVLNLFLALL 956
Nav1.8  ------------------------------------VLGNLVVLNLFIALL 889
Nav1.9  -----------------------------------TVIGKLVVLNLFIALL 810
Cav1.1  -------------------------TTAKLKIDE-----FESNVNE-------- 731
Cav1.2  -------------------------ADGESPPAT-----KINMDDLQ------- 798
Cav1.3  -------------------------NKV-----------TIDDYREE------- 811
Cav1.4  -------------------------ARR-----------EGADMEE-------- 799
Cav2.1  FWEGEAERGK---AGDPHRRHVHRQGGSPESRSGSPRTGADGEHRRHRAHRRP-----GE 970
Cav2.2  EAAGPPEARS---ERG--RGPGPE-GGRRHHRRGSPEEAAEREPRRHRAHRHQ-----DP 943
Cav2.3  CDPTQQEAGGGEAVVTFEDRARHRQSQRRSRHRRVRTEGKESSSASRSRSASQE-----RS 928
Cav3.1  ------------------------------------EDWNKVL---------- 929
Cav3.2  ------------------------------------EDWNVVL---------- 980
Cav3.3  ------------------------------------EDWNVVL---------- 792
Kv1.1   ------------------------------------RIDNT----------- 208
Kv1.2   ------------------------------------GVTFH----------- 203
Kv1.3   ------------------------------------AAGNS----------- 280
Kv1.4   ------------------------------------GLLND----------- 353
Kv1.5   ------------------------------------ANGSGVMAPPSG--- 309
Kv1.6   ------------------------------------EDDSYTFHHGITPGEM 243
Kv1.7   ------------------------------------AAGPFPAPL------ 190
Kv1.8   ------------------------------------NMSK----------- 259
Kv2.1   ------------------------------------VLSTIALSLNTLPEL 214
Kv2.2   ------------------------------------VLSTIALSLNTLPEL 218
Kv3.1   ------------------------------------RNGTQVR-------- 234
Kv3.2   ------------------------------------VVLQYEI-------- 276
Kv3.3   ------------------------------------GAPPENI-------- 337
Kv3.4   ------------------------------------GNITSVR-------- 270
Kv4.1   ------------------------------------RSSREQPC------- 223
Kv4.2   ------------------------------------HI-KELPC------- 221
Kv4.3   ------------------------------------S--KELPC------- 218
Kv5.1   ------------------------------------VLDAEG--------- 214
Kv6.1   ------------------------------------PSLREEEE------- 257
Kv6.2   ------------------------------------PDIRAEEE------- 207
Kv6.3   ------------------------------------AADNRSL-------- 206
Kv6.4   ------------------------------------PDLRAEED------- 251
Kv7.1   ------------------------------------LGSVVFIHRQELI--- 263
Kv7.2   ------------------------------------RQKHFE--------- 330
Kv7.3   ------------------------------------RQKHFE--------- 369
Kv7.4   ------------------------------------RQKHFE--------- 336
Kv7.5   ------------------------------------RQKHFE--------- 364
Kv8.1   ------------------------------------GVISIIF------- 219
Kv8.2   ------------------------------------ALNTVEEMQQ----- 287
Kv9.1   ------------------------------------AVAAVAAG------- 260
Kv9.2   ------------------------------------DSQGNPGE------- 223
Kv9.3   ------------------------------------DSQGNPGE------- 223
Kv10.1  ------------------------------------LDHYIE--------- 373
Kv10.2  ------------------------------------LDHYLE--------- 343
Kv11.1  ------------------------------------LDRYSE--------- 544
Kv11.2  ------------------------------------LDRYSE--------- 395
Kv11.3  ------------------------------------LDRYSE--------- 546
Kv12.1  ------------------------------------LDRYSQ--------- 350
Kv12.2  ------------------------------------LDRYSQ--------- 354
Kv12.3  ------------------------------------LERYSQ--------- 356
HCN1    ------------------------------------MLSMI---------- 380
HCN2    ------------------------------------MLSMI---------- 449
HCN3    ------------------------------------MLSMI---------- 333
HCN4    ------------------------------------MLSMI---------- 500
```

Figure 15AE

```
CatSper1    -----------------------------------------HSSVGSYQ-------  257
CatSper2    -----------------------------------------SEYTR----------  268
CatSper3    -----------------------------------------TVY------------  175
CatSper4    -----------------------------------------SINYTL---------  185
Hv1         -----------------------------------------ALLVLAELIL-----  122
KCa1.1      -----------------------------------------KRHFTQVEFYQ---  467
KCa4.1      -----------------------------------------MYGRC---------  556
KCa4.2      -----------------------------------------MYGRC---------  484
TPC1        -----------------------------------------PAGISYRQFE----  436

Shaker      ----TNGTKIEEDE-VPDITDPFF--------------------------------  280
Nav1.1      LSSFSA--DNLAATDDDNEMNNLQIAVDRMHKGVAYVKR------KIYEFIQQSFI----  1039
Nav1.2      LSSFSS--DNLAATDDDNEMNNLQIAVGRMQKGIDFVKR------KIREFIQKAFV----  1030
Nav1.3      LSSFSS--DNLAATDDDNEMNNLQIAVGRMQKGIDYVKN------KMRECFQKAFF----  1031
Nav1.4      LSSFSA--DSLAASDEDGEMNNLQIAIGRIKLGIGFAKAFLLGLLHGKILSPKDIMLSL-  858
Nav1.5      LSSFSA--DNLTAPDEDREMNNLQLALARIQRGLRFVKR------TTWDFCCGLLRQRPQ  990
Nav1.6      LSSFSA--DNLAATDDGEMNNLQISVIRIKKGVAWTKL------KVHAF---MQA----  1021
Nav1.7      LSSFSS--DNLTAIEEDPDANNLQIAVTRIKKGINYVKQ------TLREFILKAFS----  1004
Nav1.8      LNSFSA--DNLTAPEDDGEVNNLQ-VALARIQVFGHRTKQ----ALCSFFSRSCPFPQP-  941
Nav1.9      LNSFSNEERNGNLEGEAR-KTKVQLALDRFRRAFCFVRH------TLEHFCHKWCR----  859
Cav1.1      ----VKDPYPSADFPGDDEEDEPEIPL---------SPRPRPLAELQLKEKAVPIPEA--  776
Cav1.2      -PNENEDKSPYPNPETTGEEDEEEPE-------MPVGPRPRPLSELHLKEKAVPMPEA--  848
Cav1.3      ------DEDKDPYPPCDVPVGEEEEEEEEDEPEVPAGPRPPRISELNMKEKIAPIPEG--  863
Cav1.4      -EEEEEEEEEEEEEEEGAGGVELLQE------------------VVPKEKVVPIPEG--  837
Cav2.1      EGPEDKAERPARHREGSRPARGGE------------GEGEGPDGGERRRRHRHGAPATYE  1018
Cav2.2      SKECAGAKGERRARHRGGPRA--------------GPREAESGEEPARRHRARHKAQ--  986
Cav2.3      LDEAMPTEGEKDHELRGNHGAKEPTIQEE------RAQDLPRTNSLMVSRGSGLAGGL--  980
Cav3.1      ----YNGMASTSSWAALYFIALMTFGNYVLFNLLVAILVEGFQ-----------------  968
Cav3.2      ----YNGMASTSSWAALYFVALMTFGNYVLFNLLVAILVEGFQ-----------------  1019
Cav3.3      ----YNGMASTSPWASLYFVALMTFGNYVLFNLLVAILVEGFQ-----------------  831
Kv1.1       ----TVIYN------SNIFTDPFF--------------------------------  222
Kv1.2       ----TYSNSTIGYQQSTSFTDPFF--------------------------------  223
Kv1.3       ----TSGSRAGASSFSDPFFV-----------------------------------  297
Kv1.4       ----TSAPHLENSG-HTIFNDPFF--------------------------------  372
Kv1.5       ---PTVAPLLPRTL-----ADPFF--------------------------------  325
Kv1.6       ---GTGGSSSLSTLGGSFFTDPFF--------------------------------  264
Kv1.7       -----NGSSQMPGNPPRLPFNDPFF-------------------------------  210
Kv1.8       ------TVLSQ---------TMFTDPFF----------------------------  272
Kv2.1       QSLDEFGQSTDNPQLAHVEAV-----------------------------------  235
Kv2.2       QETDEFGQLNDNPQLAHVEAV-----------------------------------  239
Kv3.1       -----YYREAETEAFLTYIEGV----------------------------------  251
Kv3.2       -----ETDPALT------YVEGV---------------------------------  288
Kv3.3       -----TNVEVETEPFLTYVEGV----------------------------------  354
Kv3.4       -----FRREVETEPILTYIEGV----------------------------------  287
Kv4.1       -------GERFPQAFFCMDTAC----------------------------------  238
Kv4.2       -------GERYAVAFFCLDTAC----------------------------------  236
Kv4.3       -------GERYSVAFFCLDTAC----------------------------------  233
Kv5.1       ------NRVEHPTLENVETACIG---------------------------------  231
Kv6.1       ------QGHCSQMCHNVFIVESV---------------------------------  274
Kv6.2       ------RGECSPKCRSLFVLETV---------------------------------  224
Kv6.3       -------DDRSRYSAGPGREPSGIIE------------------------------  225
Kv6.4       ------QGECSRKCYYIFIVETI---------------------------------  268
Kv7.1       ----TTLYIGFLGLIFSSYFVYL---------------------------------  282
Kv7.2       ------KRRNP-----AAGLIQSA--------------------------------  343
Kv7.3       ------KRRKP-----AAELIQAA--------------------------------  382
Kv7.4       ------KRRMP-----AANLIQAA--------------------------------  349
Kv7.5       ------KRRNP-----AANLIQCV--------------------------------  377
Kv8.1       ------VVVSIINMALMSAELSWLDLQLLEILE-----------------------  246
Kv8.2       ------HSGQGEGGPDLRPILEHVEM------------------------------  307
Kv9.1       ------RSPEGVRDDPVLRRLEYF--------------------------------  278
Kv9.2       ------DPRFEIVEHPGIAWFTFE--------------------------------  241
Kv9.3       ------DPRFEIVEHPGIAWFTFE--------------------------------  241
```

Figure 15AF

```
Kv10.1      ----YGAAVLVLLVCVFGLAA------------------------------------  390
Kv10.2      ----YGAAVLVLLVCVFGLVA------------------------------------  360
Kv11.1      ----YGAAVLFLLMCTFALIA------------------------------------  561
Kv11.2      ----YGAAVLFLLMCTFALIA------------------------------------  412
Kv11.3      ----YGAAVLMLLMCIFALIA------------------------------------  563
Kv12.1      ----HSTIVLTLLMSMFALLA------------------------------------  367
Kv12.2      ----YSAVVLTLLMAVFALLA------------------------------------  371
Kv12.3      ----CSAVVLTLLMSVFALLA------------------------------------  373
HCN1        ----VGATC----YAMFVGHA------------------------------------  393
HCN2        ----VGATC----YAMFIGHA------------------------------------  462
HCN3        ----VGATC----YAMFIGHA------------------------------------  346
HCN4        ----VGATC----YAMFIGHA------------------------------------  513
CatSper1    -----RGISDYHSEYHQGDRHPSE---------------------------------  276
CatSper2    -----SPRQDLEYHVFFSDLPNSLV--------------------------------  288
CatSper3    ----TVASVLLLLFLLMYIFAILG---------------------------------  195
CatSper4    -----RALRLVHVCMAVEPLARII---------------------------------  204
Hv1         -----DLKIIQPDKNNYAAM-------------------------------------  137
KCa1.1      ----GSVLNPHDLARVKIESA------------------------------------  484
KCa4.1      ----SGNEVYHIRMGDSKFFREYE--GKSFTY-------------------------  582
KCa4.2      ----SGNEVYHIVLEESTFFAEYE--GKSFTY-------------------------  510
TPC1        -----GLMRFYKPRMSARERYLTF---------------------------------  455

Shaker      ---------------------------------------------------------
Nav1.1      --R-KQKILDEIKPLDDLNNKKDSCMSNHTAEI-GK-----------DLDYLKDVNGT---  1082
Nav1.2      --R-KQKALDEIKPLEDLNNKKDSCISNHTTIEIGK-----------DLNYLKDGNGT---  1074
Nav1.3      --R-KPKV-----IEIHEGNKIDSCMSNNTGIEISK-----------ELNYLRDGNGT---  1070
Nav1.4      GEADGAGEAGEAGETAPEDEKKEPPEEDLKK-----------------------D---  890
Nav1.5      KPAALAAQGQLPSCIA--TPYSPPPPETEKVPPTRKETRPEEGEQPGQGTPGDPEPV---  1045
Nav1.6      --RFKQREADEVKPLDELYEKKANCIANHTGADIHR-----------NGDFQKNGNGT---  1066
Nav1.7      --K-KPKISREIRQAEDLNTKKENYISNHTLAEMSK-----------G-HNFLKEKDK---  1047
Nav1.8      ------KAEPELVVKLPLSSSKAENHIAANTARGSSGGLQ---------APRGPRDEH---  984
Nav1.9      ----KQNL-------PQQKEVAGGCAAQSKDIIPLV-----------MEMKRGSETQEE  896
Cav1.1      ---------------------------------------------------------
Cav1.2      ---------------------------------------------------------
Cav1.3      ---------------------------------------------------------
Cav1.4      ---------------------------------------------------------
Cav2.1      GDARREDKERRH--RRRKENQGSGVPVSGPNLSTTRPIQQDLGRQDPPLAEDIDNMKNNK  1076
Cav2.2      --PAHEAVEKETTEKEAEIVEADKEKEL-----------------------RNHQ  1021
Cav2.3      --------DEADTPLVLPHPELEVGK-HVVLTEQ-----------------EPEGSSE  1012
Cav3.1      ---------------------------------------------------------
Cav3.2      ---------------------------------------------------------
Cav3.3      ---------------------------------------------------------
Kv1.1       ---------------------------------------------------------
Kv1.2       ---------------------------------------------------------
Kv1.3       ---------------------------------------------------------
Kv1.4       ---------------------------------------------------------
Kv1.5       ---------------------------------------------------------
Kv1.6       ---------------------------------------------------------
Kv1.7       ---------------------------------------------------------
Kv1.8       ---------------------------------------------------------
Kv2.1       ---------------------------------------------------------
Kv2.2       ---------------------------------------------------------
Kv3.1       ---------------------------------------------------------
Kv3.2       ---------------------------------------------------------
Kv3.3       ---------------------------------------------------------
Kv3.4       ---------------------------------------------------------
Kv4.1       ---------------------------------------------------------
Kv4.2       ---------------------------------------------------------
Kv4.3       ---------------------------------------------------------
Kv5.1       ---------------------------------------------------------
Kv6.1       ---------------------------------------------------------
Kv6.2       ---------------------------------------------------------
Kv6.3       ---------------------------------------------------------
```

Figure 15AG

```
Kv6.4     ------------------------------------------------------------
Kv7.1     ------------------------------------------------------------
Kv7.2     ------------------------------------------------------------
Kv7.3     ------------------------------------------------------------
Kv7.4     ------------------------------------------------------------
Kv7.5     ------------------------------------------------------------
Kv8.1     ------------------------------------------------------------
Kv8.2     ------------------------------------------------------------
Kv9.1     ------------------------------------------------------------
Kv9.2     ------------------------------------------------------------
Kv9.3     ------------------------------------------------------------
Kv10.1    ------------------------------------------------------------
Kv10.2    ------------------------------------------------------------
Kv11.1    ------------------------------------------------------------
Kv11.2    ------------------------------------------------------------
Kv11.3    ------------------------------------------------------------
Kv12.1    ------------------------------------------------------------
Kv12.2    ------------------------------------------------------------
Kv12.3    ------------------------------------------------------------
HCN1      ------------------------------------------------------------
HCN2      ------------------------------------------------------------
HCN3      ------------------------------------------------------------
HCN4      ------------------------------------------------------------
CatSper1  ------------------------------------------------------------
CatSper2  ------------------------------------------------------------
CatSper3  ------------------------------------------------------------
CatSper4  ------------------------------------------------------------
Hv1       ------------------------------------------------------------
KCa1.1    ------------------------------------------------------------
KCa4.1    ------------------------------------------------------------
KCa4.2    ------------------------------------------------------------
TPC1      ------------------------------------------------------------

Shaker    ------------------------------------------------------------
Nav1.1    ----TSGIGTGSSVEKYIIDE------SDYM--SFINNPSLTVTVPI--AVGES------ 1122
Nav1.2    ----TSGIG--SSVEKYVVDE------SDYM--SFINNPSLTVTVPI--AVGES------ 1112
Nav1.3    ----TSGVGTGSSVEKYVIDE------NDYM--SFINNPSLTVTVPI--AVGES------ 1110
Nav1.4    ----NHILNHMGLADGPPSSL------ELDRL-NFINNPYLTIQVPI--ASEES------ 931
Nav1.5    ----CVPIAVAESDTDDQEED------EENSL-GTEEESSKQQESQP--VS--G------ 1084
Nav1.6    ----TSGIG--SSVEKYIIDE------DHMS---FINNPNLTVRVPI--AVGES------ 1103
Nav1.7    ----ISGFG---SSVDKHLME------DSDGQ-SFIHNPSLTVTVPI--APGES------ 1085
Nav1.8    ----SDFIANPTVWVSVPIAE------GESDLDDLEDDGGEDAQSFQQEVIPKGGQEQLQ 1034
Nav1.9    LGILTSVPKTLGVRHDWTWLAPLAEEEDDVEFSGEDNAQRITQPEPEQQAYELH------ 950
Cav1.1    ------------------------------------------------------------
Cav1.2    ------------------------------------------------------------
Cav1.3    ------------------------------------------------------------
Cav1.4    ------------------------------------------------------------
Cav2.1    LATAESAAPHGSLGHAGLPQSPAKMGNSTDPGPMLAIPAMATNPQNAASRPTPNNFGNPS 1136
Cav2.2    PREPHCDLETSGTVTVGP--------MHTLPSTC-----LQKVEEQPEDADNQRN----- 1063
Cav2.3    QALLGNVQLDMGRVI----------SQSEPDLS-----CITA--NTDKATTESTS---- 1050
Cav3.1    ------------------------------------------------------------
Cav3.2    ------------------------------------------------------------
Cav3.3    ------------------------------------------------------------
Kv1.1     ------------------------------------------------------------
Kv1.2     ------------------------------------------------------------
Kv1.3     ------------------------------------------------------------
Kv1.4     ------------------------------------------------------------
Kv1.5     ------------------------------------------------------------
Kv1.6     ------------------------------------------------------------
Kv1.7     ------------------------------------------------------------
Kv1.8     ------------------------------------------------------------
Kv2.1     ------------------------------------------------------------
Kv2.2     ------------------------------------------------------------
```

Figure 15AH

```
Kv3.1    ------------------------------------------------------------
Kv3.2    ------------------------------------------------------------
Kv3.3    ------------------------------------------------------------
Kv3.4    ------------------------------------------------------------
Kv4.1    ------------------------------------------------------------
Kv4.2    ------------------------------------------------------------
Kv4.3    ------------------------------------------------------------
Kv5.1    ------------------------------------------------------------
Kv6.1    ------------------------------------------------------------
Kv6.2    ------------------------------------------------------------
Kv6.3    ------------------------------------------------------------
Kv6.4    ------------------------------------------------------------
Kv7.1    ------------------------------------------------------------
Kv7.2    ------------------------------------------------------------
Kv7.3    ------------------------------------------------------------
Kv7.4    ------------------------------------------------------------
Kv7.5    ------------------------------------------------------------
Kv8.1    ------------------------------------------------------------
Kv8.2    ------------------------------------------------------------
Kv9.1    ------------------------------------------------------------
Kv9.2    ------------------------------------------------------------
Kv9.3    ------------------------------------------------------------
Kv10.1   ------------------------------------------------------------
Kv10.2   ------------------------------------------------------------
Kv11.1   ------------------------------------------------------------
Kv11.2   ------------------------------------------------------------
Kv11.3   ------------------------------------------------------------
Kv12.1   ------------------------------------------------------------
Kv12.2   ------------------------------------------------------------
Kv12.3   ------------------------------------------------------------
HCN1     ------------------------------------------------------------
HCN2     ------------------------------------------------------------
HCN3     ------------------------------------------------------------
HCN4     ------------------------------------------------------------
CatSper1 ------------------------------------------------------------
CatSper2 ------------------------------------------------------------
CatSper3 ------------------------------------------------------------
CatSper4 ------------------------------------------------------------
Hv1      ------------------------------------------------------------
KCa1.1   ------------------------------------------------------------
KCa4.1   ------------------------------------------------------------
KCa4.2   ------------------------------------------------------------
TPC1     ------------------------------------------------------------

Shaker   ------------------------------------------------------------
Nav1.1   -DFENLNTEDFSSESDLEESK-----EKLNESS-------------------SSSEGSTVD 1158
Nav1.2   -DFENLNTEEFSSESDMEESK-----EKLNATS-------------------SSE-GSTVD 1147
Nav1.3   -DFENLNTEEFSSESELEESK-----EKLNATS-------------------SSE-GSTVD 1145
Nav1.4   -DLEMPTEEETDTFSEPEDSK----KPPQPLYD-------------------GNSSVCSTAD 969
Nav1.5   -GPEAPPDSRTWSQVSATASSEAEASASQADWRQQWKAEPQAPGCGETPEDSCSEGSTAD 1143
Nav1.6   -DFENLNTEDVSSESDPEGSK-----DKLDDTS-------------------SSE-GSTID 1138
Nav1.7   -DLENMNAEELSSDSDSEYSK-----VRLNRSS-------------------SSE-CSTVD 1120
Nav1.8   QVERCGDHLTPRSPGTGTSSEDLAPSLGETWKDESVPQVPAEGVDD----TSSSEGSTVD 1090
Nav1.9   --QENKKPTSQRVQSVEIDMF------SEDEPHLTIQ---------------DPRKKSDVT 988
Cav1.1   ------------------------------------------------------------
Cav1.2   ------------------------------------------------------------
Cav1.3   ------------------------------------------------------------
Cav1.4   ------------------------------------------------------------
Cav2.1   NPGPPKTPENSLIVTNP--SGTQTNSAKTARKPDHTTVDIPPACPPPLNHTVVQVNKNAN 1194
Cav2.2   --------------VTRM--GSQPPDPNTIVRIPVMLTGPLGEA-------TVVPSGNVDL 1101
Cav2.3   ---------------VTVAIPDVDPLV-DSTVVHISNKTDGEASPL------KEAEIREDEE 1090
Cav3.1   ------------------------------------------------------------
Cav3.2   ------------------------------------------------------------
```

Figure 15AI

```
Cav3.3     --------------------------------------------------------------
Kv1.1      --------------------------------------------------------------
Kv1.2      --------------------------------------------------------------
Kv1.3      --------------------------------------------------------------
Kv1.4      --------------------------------------------------------------
Kv1.5      --------------------------------------------------------------
Kv1.6      --------------------------------------------------------------
Kv1.7      --------------------------------------------------------------
Kv1.8      --------------------------------------------------------------
Kv2.1      --------------------------------------------------------------
Kv2.2      --------------------------------------------------------------
Kv3.1      --------------------------------------------------------------
Kv3.2      --------------------------------------------------------------
Kv3.3      --------------------------------------------------------------
Kv3.4      --------------------------------------------------------------
Kv4.1      --------------------------------------------------------------
Kv4.2      --------------------------------------------------------------
Kv4.3      --------------------------------------------------------------
Kv5.1      --------------------------------------------------------------
Kv6.1      --------------------------------------------------------------
Kv6.2      --------------------------------------------------------------
Kv6.3      --------------------------------------------------------------
Kv6.4      --------------------------------------------------------------
Kv7.1      --------------------------------------------------------------
Kv7.2      --------------------------------------------------------------
Kv7.3      --------------------------------------------------------------
Kv7.4      --------------------------------------------------------------
Kv7.5      --------------------------------------------------------------
Kv8.1      --------------------------------------------------------------
Kv8.2      --------------------------------------------------------------
Kv9.1      --------------------------------------------------------------
Kv9.2      --------------------------------------------------------------
Kv9.3      --------------------------------------------------------------
Kv10.1     --------------------------------------------------------------
Kv10.2     --------------------------------------------------------------
Kv11.1     --------------------------------------------------------------
Kv11.2     --------------------------------------------------------------
Kv11.3     --------------------------------------------------------------
Kv12.1     --------------------------------------------------------------
Kv12.2     --------------------------------------------------------------
Kv12.3     --------------------------------------------------------------
HCN1       --------------------------------------------------------------
HCN2       --------------------------------------------------------------
HCN3       --------------------------------------------------------------
HCN4       --------------------------------------------------------------
CatSper1   --------------------------------------------------------------
CatSper2   --------------------------------------------------------------
CatSper3   --------------------------------------------------------------
CatSper4   --------------------------------------------------------------
Hv1        --------------------------------------------------------------
KCa1.1     --------------------------------------------------------------
KCa4.1     --------------------------------------------------------------
KCa4.2     --------------------------------------------------------------
TPC1       --------------------------------------------------------------

Shaker     ----------------------------------LIETLCI---------IWFTFELTVRF 298
Nav1.1     IGAPVEEQPV--VEPEETLEPEACFTE----GCV-QRFKCC---------QINVEEG-RGKQ 1203
Nav1.2     IGAPAEGEQPE-VEPEESLEPEACFTE----DCV-RKFKCC---------QISIEEG-KGKL 1193
Nav1.3     VVLPREGEQAE-TEPEEDLKPEACFTE----GCI-KKFPPC---------QVSTEEG-KGKI 1191
Nav1.4     YKPPEEDPEEQAEENPEGEQPEECFTE-----ACV-QRWPCL--------YVDISQG-RGKK 1016
Nav1.5     MTNTAELLEQIPDLGQDVKDPEDCFTE-----GCV-RRCPCC--------AVDTTQA-PGKV 1190
Nav1.6     IKPEVEEVPV---EQPEEYLDPDACFTE----GCV-QRFKCC--------QVNIEEG-LGKS 1183
```

Figure 15AJ

```
Nav1.7     NPLPGEGEEAE-AEPMNSDEPEACFTD---GCV-RPFSCC--------QVNIESG-KGKI 1166
Nav1.8     CLDPEEILRKIPELADDLEEPDDCFTE---GCI-RHCPCC--------KLDTTKSPWDVG 1138
Nav1.9     SILSECSTIDL--QDGFGWLPEMVPKKQPERCLPKGFGCCFPC-----CSVDKRKPPWVI 1041
Cav1.1     ------------------------------SSFFIFSPTNKIR------VLCHRIVNATW 800
Cav1.2     ------------------------------SAFFIFSSNNRFR------LQCHRIVNDTI 872
Cav1.3     ------------------------------SAFFILSKTNPIR------VGCHKLINHHI 887
Cav1.4     ------------------------------SAFFCLSQTNPLR------KGCHTLIHHHV 861
Cav2.1     PDPLPKKEEEKKEEEEDDRGEDGPKPMPPYSSMFILSTTNPLR------RLCHYILNLRY 1248
Cav2.2     ESQAEG----KKEVEADDVMRSGPRPIVPYSSMFCLSPTNLLR------RFCHYIVTMRY 1151
Cav2.3     EVEKKKQ---KKEKRETGKAMVF------HSSMFIFSTTNPIR------RACHYIVNLRY 1135
Cav3.1     ------------------------------AEEISKREDASGQLSCIQLPVDSQGGDANK 998
Cav3.2     ------------------------------AE---GDANRS---------DTDEDKT-SV 1036
Cav3.3     ------------------------------AE---GDANRS---------YSDEDQS-SS 848
Kv1.1      --------------------------------IVETLCI----------IWFSFELVVRF 240
Kv1.2      --------------------------------IVETLCI----------IWFSFEFLVRF 241
Kv1.3      ---------------------------------VETLCI----------IWFSFELLVRF 314
Kv1.4      --------------------------------IVETVCI----------VWFSFEFVVRC 390
Kv1.5      --------------------------------IVETTCV----------IWFTFELLVRF 343
Kv1.6      --------------------------------LVETLCI----------VWFTFELLVRF 282
Kv1.7      --------------------------------VVETLCI----------CWFSFELLVRL 228
Kv1.8      --------------------------------MVESTCI----------VWFTFELVLRF 290
Kv2.1      ------------------------------------CI-----------AWFTMEYLLRF 248
Kv2.2      ------------------------------------CI-----------AWFTMEYLLRF 252
Kv3.1      ------------------------------------CV-----------VWFTFEFLMRV 264
Kv3.2      ------------------------------------CV-----------VWFTFEFLVRI 301
Kv3.3      ------------------------------------CV-----------VWFTFEFLMRI 367
Kv3.4      ------------------------------------CV-----------LWFTLEFLVRI 300
Kv4.1      ------------------------------------V------------LIFTGEYLLRL 250
Kv4.2      ------------------------------------V------------MIFTVEYLLRL 248
Kv4.3      ------------------------------------V------------MIFTVEYLLRL 245
Kv5.1      -------------------------------------------------WFTLEYLLRL 241
Kv6.1      ------------------------------------CV-----------GWFSLEFLLRL 287
Kv6.2      ------------------------------------CV-----------AWFSFEFLLRS 237
Kv6.3      ------------------------------------AICI---------GWFTAECIVRF 240
Kv6.4      ------------------------------------CV-----------AWFSLEFCLRF 281
Kv7.1      -------------------------------------------------AEKDAVNESG 292
Kv7.2      ------------------------------------WRF----------YATNLSRT 354
Kv7.3      ------------------------------------WRY----------YATNPNRI 393
Kv7.4      ------------------------------------WRL----------YSTDMSRA 360
Kv7.5      ------------------------------------WRS----------YAADEKSV 388
Kv8.1      ------------------------------------YVCI---------SWFTGEFVLRF 261
Kv8.2      ------------------------------------LCMGFF-------TLEYLLRL 321
Kv9.1      ------------------------------------CI-----------AWFSFEVSSRL 291
Kv9.2      ------------------------------------LV-----------APF---AV--- 248
Kv9.3      ------------------------------------LV-----------APF---AV--- 248
Kv10.1     ------------------------------------HWMA---------CIWYSIG- 401
Kv10.2     ------------------------------------HWLA---------CIWYSIG- 371
Kv11.1     ------------------------------------HWLA---------CIWYAIG- 572
Kv11.2     ------------------------------------HWLA---------CIWYAIG- 423
Kv11.3     ------------------------------------HWLA---------CIWYAIG- 574
Kv12.1     ------------------------------------HWMA---------CIWYVIG- 378
Kv12.2     ------------------------------------HWVA---------CVWFYIGQ 383
Kv12.3     ------------------------------------HWMA---------CIWYVIG- 384
HCN1       ------------------------------------TALIQ--------SLDSSRRQ 406
HCN2       ------------------------------------TALIQ--------SLDSSRRQ 475
HCN3       ------------------------------------TALIQ--------SLDSSRRQ 359
HCN4       ------------------------------------TALIQ--------SLDSSRRQ 526
CatSper1   ------------------------------------YH-----------HGDHP 283
CatSper2   ------------------------------------TVFILF-------TLDHWYAL 302
CatSper3   ------------------------------------FCLFGSPDN 204
CatSper4   ---------------------------------------------------------
Hv1        ---------------------------------------------------------
```

Figure 15AK

```
KCa1.1    ---------------------------------DACLILANKYCADPDAEDASNI 506
KCa4.1    ---------------------------AAFHAH--------------KKYGV 593
KCa4.2    ---------------------------ASFHAH--------------KKFGV 521
TPC1      --------------------------KALNQNNTPLL------SLKDFYDIYE 476

Shaker    LACPNKLNF---------------CRDVMNVIDII------------------ 318
Nav1.1    WWNLRTCFRIVEHNWFETFIVFMILLSSGALAFEDIYIDQRKTIKTMLEYADKVFTYIF 1263
Nav1.2    WWNLRKTCYKIVEHNWFETFIVFMILLSSGALAFEDIYIEQRKTIKTMLEYADKVFTYIF 1253
Nav1.3    WWNLRKTCYSIVEHNWFETFIVFMILLSSGALAFEDIYIEQRKTIKTMLEYADKVFTYIF 1251
Nav1.4    WWTLRRACFKIVEHNWFETFIVFMILLSSGALAFEDIYIEQRRVIRTILEYADKVFTYIF 1076
Nav1.5    WWRLRKTCYHIVERSWFETFIIFMILLSSGALAFEDIYLEERKTIKVLLEYADKMFTYVF 1250
Nav1.6    WWILRKTCFLIVEHNWFETFIIFMILLSSGALAFEDIYIEQRKTIRTILEYADKVFTYIF 1243
Nav1.7    WWNIRKTCYKIVEHSWFESFIVLMILLSSGALAFEDIYIERKKTIKIILEYADKIFTYIF 1226
Nav1.8    WQV-RKTCYRIVERSWFESFIIFMILLSSGSLAFEDYYLDQKPTVKALLEYTDRVFTFIF 1197
Nav1.9    WWNLRKTCYQIVKRSWFESFIIFVILLSSGALIFEDVHLENQPKIQELLNCTDIIFTHIF 1101
Cav1.1    FTNFILLFTILLSSAALAAEDPIRADSMRNQILKRFDIGFTSVFTVEIVLKMTTYGAFLHK 860
Cav1.2    FTNLILFFTILLSSISLAAEDPVQHTSFRNHILFYFDIVFTFIFTIEIALKMTAYGAFLHK 932
Cav1.3    FTNLIILVFIMLSSAALAAEDPIRSHSFRNTILGYFDYAFTAIFTVEILLKMTTFGAFLHK 947
Cav1.4    FTNLIILVFTIILSSVSLAAEDPIRAHSFRNHILGYFDYAFTSIFTVEILLKMTVFGAFLHR 921
Cav2.1    FEMCIILMVIAMSSIALAAEDPVQPNAPRNNVLRYFDYVFTGVFTFEMVIKMIDLGLVLHQ 1308
Cav2.2    FEVVIILVVIALSSIALAAEDPVRTDSPRNNALKYLDYIFTGVFTFEMVIKMIDLGLLLHP 1211
Cav2.3    FEMCILLVIAASSIALAAEDPVLTNSERNKVLRYFDYVFTGVFTFEMVIKMIDQGLILQD 1195
Cav3.1    SESEPDFFSPSL--------------DGDGDRKK----CIALVSLGEHPELRKSLLPPLI 1040
Cav3.2    HFEEDFH--------------KLRELQTTELKMCSLAVTPNGHLEGRGSLSPPLI 1077
Cav3.3    NIEEFDKLQEGL--------------DSSGDPKLCPIPMTPNGHLDPSLPLGGHLGPAGA 894
Kv1.1     FACPSKTDF---------------FKNIMNFIDIV------------------ 260
Kv1.2     FACPSKAGF---------------FTNIMNIIDIV------------------ 261
Kv1.3     FACPSKATF---------------SRNIMMLIDIV------------------ 334
Kv1.4     FACPSQALF---------------FKNIMNIIDIV------------------ 410
Kv1.5     FACPSKAGF---------------SRNIMNIIDVV------------------ 363
Kv1.6     SACPSKPAF---------------FRNIMNIIDLV------------------ 302
Kv1.7     LVCPSKAIF---------------FKNVMNLIDFV------------------ 248
Kv1.8     VVCPSKTDF---------------FRNIMNIIDII------------------ 310
Kv2.1     LSSPKKWKF---------------FKGPLNAIDLL------------------ 268
Kv2.2     LSSPNKWKF---------------FKGPLNVIDLL------------------ 272
Kv3.1     IFCPNKVEF---------------IKNSLNIIDFV------------------ 284
Kv3.2     VFSPNKLEF---------------IKNLLNIIDFV------------------ 321
Kv3.3     TFCPDKVEF---------------LKSSLNIIDCV------------------ 387
Kv3.4     VCCPDTLDF---------------VKNLLNIIDFV------------------ 320
Kv4.1     FAAPSRCRF---------------LRSVMSLID-------------------- 268
Kv4.2     AAAPSRYRF---------------VRSVMSIID-------------------- 266
Kv4.3     FAAPSRYRF---------------IRSVMSIID-------------------- 263
Kv5.1     FSSPNKLHFALSF-----------MNIVDVLAILP------------------ 265
Kv6.1     IQAPSKFAF---------------LRSPLTLIDLV------------------ 307
Kv6.2     LQAESKCAF---------------LRAPLNIIDIL------------------ 257
Kv6.3     IVSKNKCEF---------------VKRPLNIIDLL------------------ 260
Kv6.4     VQAQDKCQF---------------FQGPLNIIDIL------------------ 301
Kv7.1     RVEFGSYADAL-------------WWGVVTVTTI------------------- 313
Kv7.2     DLHSTWQYYE--------------RTVTVPMYSS------QTQT--------- 378
Kv7.3     DLVATW------------------RFYESVVS--------PPFF--------- 411
Kv7.4     YL----------------------TATWYYY-D-------SILP--------- 374
Kv7.5     SIATWKPH----------------LKALHTCSPT------KKEQ--------- 410
Kv8.1     LCVRDPCRFL--------------RKVPNIIDLL------------------- 281
Kv8.2     ASTPDLRRF---------------ARSALNLVDLVAILPLYLQ---------- 349
Kv9.1     LLAPSTRNF---------------FCHPLNLIDIV------------------ 311
Kv9.2     --APDFLKF---------------FKNALNLIDLM------------------ 266
Kv9.3     --APDFLKF---------------FKNALNLIDLM------------------ 266
Kv10.1    ------------------------DYEIFDEDTKTIRNNSWLY---------- 420
Kv10.2    ------------------------DYEVIDEVTNTIQIDSWLY---------- 390
Kv11.1    ------------------------NMEQPHMDS----RIGWLH---------- 587
Kv11.2    ------------------------NVERPYLEH----KIGWLD---------- 438
Kv11.3    ------------------------NVERPYLTD----KIGWLD---------- 589
Kv12.1    ------KMERE-------------DNSLLKWEV-------GWLH--------- 396
```

Figure 15AL

```
Kv12.2     REIESSESELPEIGWLQ--------ELAPRLETPYYL---VGPRPA------------- 418
Kv12.3     ----RREME--------------ANDPLLWDI------GWLH---------------- 402
HCN1       YQEKYKQ----------------VEQYMSFH------KLPA---------------- 425
HCN2       YQEKYKQ----------------VEQYMSFH------KLPA---------------- 494
HCN3       YQEKYKQ----------------VEQYMSFH------KLPA---------------- 378
HCN4       YQEKYKQ----------------VEQYMSFH------KLPP---------------- 545
CatSper1   HHTQHHYHQT-------------HPHRDYHQHQD----------------------- 304
CatSper2   LQDVWKVPE--------------VSRIFSSIYFIL---------------------- 323
CatSper3   GDHDNWGNL--------------AAAFFTLFSLA----------------------- 224
CatSper4   -----------------------RVILQSVPD------------------------- 213
Hv1        -----------------------VFHYMSITIL------------------------ 147
KCa1.1     MRVISIKNYHPKIRLITQ------MLQYHNKAHLLNIPSWNWKEGDDAICLAELKLGFIA 560
KCa4.1     CLI--------------------GLKREDNKSILLNPGPRHIL--------------A 617
KCa4.2     CLI--------------------GVRREDNKNILLNPGPRYI---------------M 544
TPC1       VAALKWKA---------------KKNREHWFDELP---------------------- 496

Shaker     ---AIIPYFITL--ATVVAEEEDTLNL---PKAPVSPQDKSSNQAMS---------LAILR 362
Nav1.1     ILEMLLKWVAYGYQTYFTNAWCWLDFL---IVDVSLVSLTANALGYSE-------LGAIK 1313
Nav1.2     ILEMLLKWVAYGPQVYFTNAWCWLDFL---IVDVSLVSLTANALGYSE-------LGAIK 1303
Nav1.3     ILEMLLKWVAYGPQTYFTNAWCWLDFL---IVDVSLVSLVANALGYSE-------LGAIK 1301
Nav1.4     IMEMLLKWVAYGPKVYFTNAWCWLDFL---IVDVSIISLVANWLGYSE-------LGPIK 1126
Nav1.5     VLEMLLKWVAYGPKKYFTNAWCWLDFL---IVDVSLVSLVANTLGFAE-------MGPIK 1300
Nav1.6     ILEMLLKWTAYGPVKFFTNAWCWLDFL---IVAVSLVSLIANALGYSE-------LGAIK 1293
Nav1.7     ILEMLLKWIAYGYKTYFTNAWCWLDFL---IVDVSLVTLVANTLGYSD-------LGPIK 1276
Nav1.8     VFEMLLKWVAYGPKKYFTNAWCWLDFL---IVNISLISLTAKILEYSE-------VAPIK 1247
Nav1.9     ILEMVLKWVAFGPGKYFTSAWCCLDFI---IVIVS-----VTTLINL---------MELK 1144
Cav1.1     GSFCRNYFNMLDLLVVAVSLISM--------GLESSAISVVKILRVLRVLRPLRAINRAK 912
Cav1.2     GSFCRNYFNILDLLVVSVSLISF--------GIQSSAINVVKILRVLRVLRPLRAINRAK 984
Cav1.3     GAFCRNYFNLLDMLVVGVSLVSF--------GIQSSAISVVKLLRVLRVLRPLRAINRAK 999
Cav1.4     GSFCRSWFNMLDLLVVSVSLISF--------GIHSSAISVVKILRVLRVLRPLRAINRAK 973
Cav2.1     GA-YFRDLWNILDFIVVSGALVAFAFT---GNSKGKDINTIKSLRVLRVLRPLKTIKRLP 1364
Cav2.2     GA-YFRDLWNILDFIVVSGALVAFAF----SGSKGKDINTIKSLRVLRVLRPLKTIKRLP 1266
Cav2.3     GS-YFRDLWNILDFVVVVGALVAFALANALGTNKGRDIKTIKSLRVLRVLRPLKTIKRLP 1254
Cav3.1     IHTAATPMSLPKSTSTGLGEAL-------------GPASRRTSSSGSAEPGAAHE-MKSP 1086
Cav3.2     MCTAATPMPTPKS-SPFLDAAP-------------SLPDSRRGSSSSGDPPLGD--QKPP 1121
Cav3.3     AGPAP------RL-SLQPDPML-------------VALGSPKSSVMSLG---RM--SYDQ 929
Kv1.1      ---AIIPYFITL--GTEIAEQE---------GNQK----GEQ--ATS---------LAILR 292
Kv1.2      ---AIIPYFITL--GTELAEKPE--------DAQQ----GQQ--AMS---------LAILR 294
Kv1.3      ---AIIPYFITL--GTELAERQ---------GN------GQQ--AMS---------LAILR 364
Kv1.4      ---SILPYFITL--GTDLAQQQ---------GGGN----GQQQQAMS---------FAILR 444
Kv1.5      ---AIFPYFITL--GTELAEQE---PG---GGGGG----QNGQQAMS---------LAILR 400
Kv1.6      ---AIFPYFITL--GTELVQQQEQQPA---SGGGG----QNGQQAMS---------LAILR 342
Kv1.7      ---AILPYFVAL--GTELA-----------RQR------GVGQQAMS---------LAILR 278
Kv1.8      ---SIIPYFATL--ITELVQETE-------------PSAQQNMS---------LAILR 341
Kv2.1      ---AILPYYVTIFLTESNKS------------------VLQFQNV--------RRVVQ 297
Kv2.2      ---AILPYYVTIFLTESNKS------------------VLQFQNV--------RRVVQ 301
Kv3.1      ---A------ILP--FYLEV-----------GLSGL---SSKAAKDV--------LGFLR 311
Kv3.2      ---A------ILP--FYLEV-----------GLSGL---SSKAAKDV--------LGFLR 348
Kv3.3      ---A------ILP--FYLEV-----------GLSGL---SSKAAKDV--------LGFLR 414
Kv3.4      ---A------ILP--FYLEV-----------GLSGL---SSKAARDV--------LGFLR 347
Kv4.1      -------VVAILPYYIGLLV------------------PKNDDVS--------GAFVT 293
Kv4.2      -------VVAILPYYIGLVM------------------TDNEDVS--------GAFVT 291
Kv4.3      -------VVAIMPYYIGLVM------------------TNNEDVS--------GAFVT 288
Kv5.1      ------FYVSLTLTHLGARMMEL---------------TNVQQAVQAL----------R 293
Kv6.1      ---AILPYYITLLVDGAAAG-----RR---KPGAGN----SYLDKVG--------LVL-R 343
Kv6.2      ---ALLPFY-----VSLLLG-----LA--AGPGGT----KLLERAG--------LVL-R 288
Kv6.3      ------AITPYYISVLMTVFTGE---------------NSQLQRAG--------VTLR 289
Kv6.4      ---AISPYY-----VSLAVSEEPPEDG---ERPSGS----SYLEKVG--------LVL-R 337
Kv7.1      --------------GYGDKVPQT---------------WVGKTIASCF--------SVF 335
Kv7.2      --------------YGASRLIP---------PLNQLELLPNLKS----------KS 401
Kv7.3      --------------RKEQLE-----------------AASSQ----------KL 424
Kv7.4      --------------SFRELA-----------LLFEHVQPARNG---------GL 394
```

Figure 15AM

```
Kv7.5       ---------------GEASSS----------------QKLSFKERVFMA----------SP 430
Kv8.1       ---AILPFYITLLVESLSGSQTTQELE-------------NVGRIVQVL----------R  315
Kv8.2       ------LLLECFTGEGHQRGQT------------------VGSVGKVGQ---------VLR 377
Kv9.1       ---SVLPFYLTLLAGVALGD--------QGGKEF----GHLGKVV--------QVF-R   345
Kv9.2       ---SIVPFYITL--VVNLVV--------ESTPTL----ANLGRVA--------QVL-R   298
Kv9.3       ---SIVPFYITL--VVNLVV--------ESSPTL----ANLGRVA--------QVL-R   298
Kv10.1      ---------------QLAMDIGT-------------PYQFNGSGSGKWE---------GGP 444
Kv10.2      ---------------QLALSIGT-------------PYR-YNTSAGIWE---------GGP 413
Kv11.1      ---------------NLGDQIG--------------KPYNSSGL-------------GGP 605
Kv11.2      ---------------SLGVQLG--------------KRYNGSDPA-------------SGP 457
Kv11.3      ---------------SLGQQIG--------------KRYNDSDSS-------------SGP 608
Kv12.1      ---------------ELGKRLE--------------SPYYGNNTL-------------GGP 415
Kv12.2      ---------------GGNSSGQ--------------SDNCSSSSEANGTGLELLGGP 446
Kv12.3      ---------------ELGKRLE--------------VPYVNGSV-------------GGP 420
HCN1        ---------------DMRQKI---------------HDYYEHRYQ------------GK  442
HCN2        ---------------DFRQKI---------------HDYYEHRYQ------------GK  511
HCN3        ---------------DTRQRI---------------HEYYEHRYQ------------GK  395
HCN4        ---------------DTRQRI---------------HDYYEHRYQ------------GK  562
CatSper1    ---------------HRGAYH---------------SSYLRGDYVQSTSQLSIPHTS    331
CatSper2    ---------------WLLLGSIIF------------RSIIVAMM------------VTN  343
CatSper3    ------------TVDGWTDLQ---------------KQLDNREF------------     241
CatSper4    ---------------MANIMVLILFFML--------VPSVPGVTLF-----------G   237
Hv1         ---------------VPFMMELIF------------KLFVFRLEFF----------     166
KCa1.1      QSCLAQGLSTMLANLFSMRSFI----------KIEEDTWQKYYLEGVSNEMYTEYLSSAFV 611
KCa4.1      ASDT--------CFYINIT------------KEENSAFIFKQEE------------     641
KCa4.2      NSTDI-------CFYINIT------------KEENSAFKNQDQQ-----------      569
TPC1        -RTALLIFKGINILVKSKAFQYF-----------------MYLVVAVNGVWILVETFMLK 538

Shaker      VIR--LVRVFRIF----------KL-----SRHSKG---LQILGRTLK----------AS 392
Nav1.1      SLR--TLRALRPL----------RALSRFEGMRVVV---NALLGAIPS----------IM 1348
Nav1.2      SLR--TLRALRPL----------RALSRFEGMRVVV---NALLGAIPS----------IM 1338
Nav1.3      SLR--TLRALRPL----------RALSRFEGMRVVV---NALVGAIPS----------IM 1336
Nav1.4      SLR--TLRALRPL----------RALSRFEGMRVVV---NALLGAIPS----------IM 1161
Nav1.5      SLR--TLRALRPL----------RALSRFEGMRVVV---NALVGAIPS----------IM 1335
Nav1.6      SLR--TLRALRPL----------RALSRFEGMRVVV---NALVGAIPS----------IM 1328
Nav1.7      SLR--TLRALRPL----------RALSRFEGMRVVV---NALIGAIPS----------IM 1311
Nav1.8      ALR--TLRALRPL----------RALSRFEGMRVVV---DALVGAIPS----------IM 1282
Nav1.9      SFR--TLRALRPL----------RALSQFEGMKVVV---NALIGAIPA----------IL 1179
Cav1.1      GLK--HVARCMFVAISTIGNIVLVTTLLQFMFACIG---VQLFKGKFF----------RC 957
Cav1.2      GLK--HVVQCVFVAIRTIGNIVIVTTLLQFMFACIG---VQLFKGKLY----------TC 1029
Cav1.3      GLK--HVVQCVFVAIRTIGNIMIVTTLLQFMFACIG---VQLFKGKFY----------RC 1044
Cav1.4      GLK--HVVQCVFVAIRTIGNIMIVTTLLQFMFACIG---VQLFKGKFY----------TC 1018
Cav2.1      KLK--AVFDCVVNSLKNVFNILIVYMLFMFIFAVVA---VQLFKGKFF----------HC 1409
Cav2.2      KLK--AVFDCVVNSLKNVLNILIVYMLFMFIFAVIA---VQLFKGKFF----------YC 1311
Cav2.3      KLK--AVFDCVVTSLKNVFNILIVYKLFMFIFAVIA---VQLFKGKFF----------YC 1299
Cav3.1      PSA--RSSPHSPW----------SAASSWTSRRSSR---NSLGRAPSL----------KR 1121
Cav3.2      ASL--RSSPCAPW----------GPSGAWSSRRSSW---SSLGRAPSL----------KR 1156
Cav3.3      RSL--SSSRS-------------SYYGPWGRSAAWA---SPRSSWNSL----------KH 961
Kv1.1       VIR--LVRVFRIF----------KL-----SRHSKG---LQILGQTLK----------AS 322
Kv1.2       VIR--LVRVFRIF----------KL-----SRHSKG---LQILGQTLK----------AS 324
Kv1.3       VIR--LVRVFRIF----------KL-----SRHSKG---LQILGQTLK----------AS 394
Kv1.4       IIR--LVRVFRIF----------KL-----SRHSKG---LQILGHTLR----------AS 474
Kv1.5       VIR--LVRVFRIF----------KL-----SRHSKG---LQILGKTLQ----------AS 430
Kv1.6       VIR--LVRVFRIF----------KL-----SRHSKG---LQILGKTLQ----------AS 372
Kv1.7       VIR--LVRVFRIF----------KL-----SRHSKG---LQILGQTLR----------AS 308
Kv1.8       IIR--LVRVFRIF----------KL-----SRHSKG---LQILGQTLK----------AS 371
Kv2.1       IFR--IMRILRIL----------KL-----ARHSTG---LQSLGFTLR----------RS 327
Kv2.2       IFR--IMRILRIL----------KL-----ARHSTG---LQSLGFTLR----------RS 331
Kv3.1       VVR--FVRILRIF----------KL-----TRHFVG---LRVLGHTLR----------AS 341
Kv3.2       VVR--FVRILRIF----------KL-----TRHFVG---LRVLGHTLR----------AS 378
Kv3.3       VVR--FVRILRIF----------KL-----TRHFVG---LRVLGHTLR----------AS 444
Kv3.4       VVR--FVRILRIF----------KL-----TRHFVG---LRVLGHTLR----------AS 377
```

Figure 15AN

```
Kv4.1      LRV--FRVF-RIF----------KF------SRHSQG---LRILGYTLK----------SC  322
Kv4.2      LRV--FRVF-RIF----------KF------SRHSQG---LRILGYTLK----------SC  320
Kv4.3      LRV--FRVF-RIF----------KF------SRHSQG---LRILGYTLK----------SC  317
Kv5.1      IMR--IARIFKLA----------------RHSSG---LQTLTYALK----------RS  320
Kv6.1      VLR--ALRILYVM----------RL-----ARHSLG---LQTLGLTAR----------RC  373
Kv6.2      LLR--ALRVLYVM----------RL-----ARHSLG---LRSLGLTMR----------RC  318
Kv6.3      VLR--MMRIFWVI----------KLARFIG---LQTLGLTLK----------RC  319
Kv6.4      VLR--ALRILYVM----------RL-----ARHSLG---LQTLGLTVR----------RC  367
Kv7.1      AIS--FFALPAGIL---------------GSGFAL---KVQQKQRQK----------HF  364
Kv7.2      GLA--FRKDPPP-----------------EPSPSK---GSPCRGPLC----------GC  428
Kv7.3      GLL--DRVR--------------------LSNPRG---SNTKGKLFT----------PL  448
Kv7.4      RPL--EVRR--------------------APVP---DGAPSRYPP----------VA  416
Kv7.5      RGQ--SIKS--------------------RQAS---VGDRRSPST----------DI  452
Kv8.1      LLR--ALRMLKLG----------------RHSTG---LRSLGMTIT----------QC  342
Kv8.2      VMR--LMRIFRIL----------------KLARHSTGL---RAFGFTLR----------QC  407
Kv9.1      LMR--IFRVLKLA----------R------HSTGLR-----SLGATLK----------HS  372
Kv9.2      LMR--IFRILKLA----------R------HSTGLR-----SLGATLK----------YS  325
Kv9.3      LMR--IFRILKLA----------R------HSTGLR-----SLGATLK----------YS  325
Kv10.1     SKN--SVYISSLY----------FT-----MTSLTS---VGFGNIAPS----------TD  474
Kv10.2     SKD--SLYVSSLY----------FT-----MTSLTT---IGFGNIAPT----------TD  443
Kv11.1     SIK--DKYVTALY----------FT-----FSSLTS---VGFGNVSPN----------TN  635
Kv11.2     SVQ--DKYVTALY----------FT-----FSSLTS---VGFGNVSPN----------TN  487
Kv11.3     SIK--DKYVTALY----------FT-----FSSLTS---VGFGNVSPN----------TN  638
Kv12.1     SIR--SAYIAALY----------FT-----LSSLTS---VGFGNVSAN----------TD  445
Kv12.2     SLR--SAYITSLY----------FA-----LSSLTS---VGFGNVSAN----------TD  476
Kv12.3     SRR--SAYIAALY----------FT-----LSSLTS---VGFGNVCAN----------TD  450
HCN1       IFD--EENILNEL----------------NDPLREEIVNFNC---RRLVATMPL----------FA  477
HCN2       MFD--EDSILGEL----------------NGPLREEIVNFNC---RRLVASMPL----------FA  546
HCN3       MFD--EESILGEL----------------SEPLREEIINFTC---RGLVAHMPL----------FA  430
HCN4       MFD--EESILGEL----------------SEPLREEIINFNC---RRLVASMPL----------FA  597
CatSper1   RSL--IHDAPGPA----------------ASRTGVF---PYHVAHPR----------GS  359
CatSper2   FQN--IRKELNEE----------------MARREVQLKADMFKRQII----------QR  374
CatSper3   --A--LSRAFTIIFILL--------ASFIFLNMFVG----VMIMHTED----------SI  275
CatSper4   AFV--PKHFQNIQ----------------VALYTLFICITQDGWVD----------IY  267
Hv1        -----HRKFEILDA---------------VVVVVSFILDIVLLFQEH----------QF  195
KCa1.1     GLSFPTVCELCFVKLKLLMIAIEYKSANRESRSRKRIL--INPGNHLKIQEGTLGFFIAS  669
KCa4.1     -----KRKKPAFS----------GQGLHEGPARLPV---HSIIASMGT----------VA  673
KCa4.2     -----RKSNV-------------SRSFYHGPSRLPV---HSIIASMGT----------VA  598
TPC1       GGNFFSKHVPWSYL----VFLTIYGVELFLKVAGLGPVEYLSSGWNLF----------DF  584

Shaker     MRELGLLIF------FLFIGV--------------------------------------  407
Nav1.1     NVLLVCLIFWL--IFSIMGVNLFAGKFYHCINTTTGD-RFDIED-VNNHTDCLKLIERNE 1404
Nav1.2     NVLLVCLIFWL--IFSIMGVNLFAGKFYHCINYTTGE-MFDVSV-VNNYSECKALIESNQ 1394
Nav1.3     NVLLVCLIFWL--IFSIMGVNLFAGKFYHCVMMTTGN-MFDISD-VNNLSDCQAL----GK 1389
Nav1.4     NVLLVCLIFWL--IFSIMGVNLFAGKFYYCINTTTSE-RFDISE-VNNKSECESLMHTGQ 1217
Nav1.5     NVLLVCLIFWL--IFSIMGVNLFAGKFGRCINQTEGD-LPLNYTIVNNKSQCESLNLTGE 1392
Nav1.6     NVLLVCLIFWL--IFSIMGVNLFAGKYHYCFNETSEI-RFEIED-VNNKTECEKLMEGNN 1384
Nav1.7     NVLLVCLIFWL--IFSIMGVNLFAGKFYECINTTDGS-RFPASQ-VPNRSECFALMNVSQ 1367
Nav1.8     NVLLVCLIFWL--IFSIMGVNLFAGKFWRCINYTDGEFSLVPLSIVNNKSDCKIQNSTGS 1340
Nav1.9     NVLLVCLIFWL--VFCILGVYFFSGKFGKCINGTDSV--------INYTIITNKSQCESGN 1230
Cav1.1     TDLSKMTEEECRGYYYVYKDGDPMQIE---------------------------L  985
Cav1.2     SDSSKQTEAECKGNYITYKDGEVDHPI---------------------------I 1057
Cav1.3     TDEAKSNPEECRGLFILYKDGDVDSPV---------------------------V 1072
Cav1.4     TDEAKHTPQECKGSFLVYPDGDVSRPL---------------------------V 1046
Cav2.1     TDESKEFEKDCRGKYLLYEKNEVKA----------------------------- 1434
Cav2.2     TDESKELERDCRGQYLDYEKEEVEA----------------------------- 1336
Cav2.3     TDSSKDTEKECIGNYVDHEKNKMEV----------------------------- 1324
Cav3.1     RSPSGERRSLL-SGEGQESQDEEESSEEERASPAGS------------------ 1156
Cav3.2     RGQCGERESLL-SGEGKGSTD---DEAEDGRAAPGP------------------ 1188
Cav3.3     KPPSAEHESLL-SAERGGGAR----VC--EVAADEGPP--------------------RAAFLHT  999
Kv1.1      MRELGLLIF------FLFIGV-------------------------------------- 337
Kv1.2      MRELGLLIF------FLFIGV-------------------------------------- 339
```

Figure 15AO

```
Kv1.3      MRELGLLIF------FLFIGV------------------------------- 409
Kv1.4      MRELGLLIF------FLFIGV------------------------------- 489
Kv1.5      MRELGLLIF------FLFIGV------------------------------- 445
Kv1.6      MRELGLLIF------FLFIGV------------------------------- 387
Kv1.7      MRELGLLIF------FLFIGV------------------------------- 323
Kv1.8      MRELGLLIF------FLFIGV------------------------------- 386
Kv2.1      YNELGLLIL------FLAMGI------------------------------- 342
Kv2.2      YNELGLLIL------FLAMGI------------------------------- 346
Kv3.1      TNEFLLLII------FLALGVLIFATMIY------------------------ 364
Kv3.2      TNEFLLLII------FLALGVLIFATMIY------------------------ 401
Kv3.3      TNEFLLLYI------FLALGVLIFATMIY------------------------ 467
Kv3.4      TNEFLLLYI------FLALGVLIFATMIY------------------------ 400
Kv4.1      ASELGFLLF------SLTMAI------------------------------- 337
Kv4.2      ASELGFLLF------SLTMAI------------------------------- 335
Kv4.3      ASELGFLLF------SLTMAI------------------------------- 332
Kv5.1      FKELGLLLM------YLAVGIF------------------------------ 336
Kv6.1      TREFGLLLL------FLCVAI------------------------------- 388
Kv6.2      AREFGLLLL------FLCVAM------------------------------- 333
Kv6.3      YREMVMLLVFI----CVAM--------------------------------- 334
Kv6.4      TREFGLLLL------FLAVAI------------------------------- 382
Kv7.1      NRQIPAAASLI---QTAWRCY------------------------------- 382
Kv7.2      CP-------------GRSSQK------------------------------- 436
Kv7.3      NV-------------DAIEES------------------------------- 456
Kv7.4      T--------------C------------------------------------ 418
Kv7.5      TA-------------EGSP-T------------------------------- 459
Kv8.1      YEEVGLLLLFL----SVGI--------------------------------- 357
Kv8.2      YQQVGCLLLFI----AMGIF-------------------------------- 423
Kv9.1      YREVGILLL------YLAVGV------------------------------- 387
Kv9.2      YKEVGLLLL------YLSVGI------------------------------- 340
Kv9.3      YKEVGLLLL------YLSVGI------------------------------- 340
Kv10.1     IE-------------KIFAVA------------------------------- 482
Kv10.2     VE-------------KMFSVA------------------------------- 451
Kv11.1     SE-------------KIFSIC------------------------------- 643
Kv11.2     SE-------------KVFSIC------------------------------- 495
Kv11.3     SE-------------KIFSIC------------------------------- 646
Kv12.1     AE-------------KIFSIC------------------------------- 453
Kv12.2     TE-------------KIFSIC------------------------------- 484
Kv12.3     AE-------------KIFSIC------------------------------- 458
HCN1       NA-------------DPNFVT------------------------------- 485
HCN2       NA-------------DPNFVT------------------------------- 554
HCN3       HA-------------DPSFVT------------------------------- 438
HCN4       NA-------------DPNFVT------------------------------- 605
CatSper1   AH-------------SMTRSS------------------------------- 367
CatSper2   RK-------------NMSHE-------------------------------- 381
CatSper3   RKFEREL--------------------------------------------- 282
CatSper4   SDFQ-----------TEKREY------------------------------- 277
Hv1        EALGLLILL------------------------------------------- 204
KCa1.1     DAKEVKRAFFY---CKACHDDITDP--------------------------- 691
KCa4.1     MDLQGTEHRPTQSGGGGGGSK-------LALPTENG---------------- 702
KCa4.2     IDLQDTSCR-----SASGPT-------LSLPTEGS----------------- 621
TPC1       SVTVFAFLGLLALALNMEPFYFIVVLRPLQLLRLFKL---------------- 621

Shaker     --VLFSSAYF------------------AEAGSSENS-------------FFKSIPDAF 433
Nav1.1     TARWKNVKV-N-----------------FDNVGFGYLSLLQ-------VATFKGWMDI 1437
Nav1.2     TARWKNVKV-N-----------------FDNVGLGYLSLLQ-------VATFKGWMDI 1427
Nav1.3     QARWKNVKV-N-----------------FDNVGAGYLALLQ-------VATFKGWMDI 1422
Nav1.4     VRWLNVKVN-------------------YDNVGLGYLSLLQ-------VATFKGWMDI 1249
Nav1.5     LYWTKVKVN-------------------FDNVGAGYLALLQ-------VATFKGWMDI 1424
Nav1.6     TEIRWKNVKIN-----------------FDNVGAGYLALLQ-------VATFKGWMDI 1418
Nav1.7     NVRWKNLKV-N-----------------FDNVGLGYLSLLQ-------VATFKGWTII 1400
Nav1.8     FFWVNVKVN-------------------FDNVAMGYLALLQ-------VATFKGWMDI 1372
Nav1.9     FSWINQKVN-------------------FDNVGNAYLALLQ-------VATFKGWMDI 1262
```

Figure 15AP

```
Cav1.1     RHREWVHSDFH----------------FDNVLSAMMSLFTVSTFEGWPQLLYKAIDSN 1027
Cav1.2     QPRSWENSKFD----------------FDNVLAAMMALFTVSTFEGWPELLYRSIDSH 1099
Cav1.3     RERIWQNSDPN----------------FDNVLSAMMALFTVSTFEGWPALLYKAIDSN 1114
Cav1.4     RERLWVNSDPN----------------FDNVLSAMMALFTVSTFEGWPALLYKAIDAY 1088
Cav2.1     RDREWKKYEFH----------------YDNVLWALLTLFTVSTGEGWPQVLKHSVDAT 1476
Cav2.2     QPRQWKKYDFH----------------YDNVLWALLTLFTVSTGEGWPMVLKHSVDAT 1378
Cav2.3     KGREWKRHEFH----------------YDNIIWALLTLFTVSTGEGWPQVLQHSVDVT 1366
Cav3.1     -DHRHRGSLEREAKSSFDLPDTLQVPGLHRTASGRGSASEHQD--------CNGKSASGRL 1208
Cav3.2     -RATPLRRAESLDPRPLRPAALPP----TKCRDRDGQV-------------VALPSDFFL 1230
Cav3.3     PHAHHVHHGPHLAHRHRHHRRTLS----LDNRDSVDLAELVPA-------VGAHPRAAWR 1048
Kv1.1      --ILFSSAVYF----------------AEAEEAES-------------HFSSIPDAF 363
Kv1.2      --ILFSSAVYF----------------AEADERES-------------QFPSIPDAF 365
Kv1.3      --ILFSSAVYF----------------AEADDPTS-------------GFSSIPDAF 435
Kv1.4      --ILFSSAVYF----------------AEADEPTT-------------HFQSIPDAF 515
Kv1.5      --ILFSSAVYF----------------AEADNQGT-------------HFSSIPDAF 471
Kv1.6      --ILFSSAVYF----------------AEADDDDS-------------LFPSIPDAF 413
Kv1.7      --VLFSSAVYF----------------AEVDRVDS-------------HFTSIPESF 349
Kv1.8      --ILFSSAVYF----------------AEVDEPES-------------HFSSIPDGF 412
Kv2.1      --MIFSSLVFF----------------AEKDEDDT-------------KFKSIPASF 368
Kv2.2      --MIFSSLVFF----------------AEKDEDAT-------------KFTSIPASF 372
Kv3.1      -YAERIGAQPN----------------DPSASEHT-------------HFKNIPIGF 391
Kv3.2      -YAERVGAQPN----------------DPSASEHT-------------QFKNIPIGF 428
Kv3.3      -YAERIGADPD----------------DILGSNHT-------------YFKNIPIGF 494
Kv3.4      -YAERIGARPS----------------DPRGNDHT-------------DFKNIPIGF 427
Kv4.1      --IIFATVMFY----------------AEKGTNKT-------------NFTSIPAAF 363
Kv4.2      --IIFATVMFY----------------AEKGSSAS-------------KFTSIPAAF 361
Kv4.3      --IIFATVMFY----------------AEKGSSAS-------------KFTSIPASF 358
Kv5.1      --VFSALGYTM----------------EQSHPETLF------------KSIPQSF 361
Kv6.1      -ALFAPLLYVI----------------ENEMADSP-------------EFTSIPACY 415
Kv6.2      -ALFAPLVHLA----------------ERELGARP-------------DFSSVPASY 360
Kv6.3      --AIFSALSQL----------------LEHGLDLE-------------TSMKDFTSI 360
Kv6.4      -TLFSPLVYVA----------------EKESGRVL-------------EFTSIPASY 409
Kv7.1      -AAENPDSSTW--------------KIYIRKAPRSHTLLSPSP------KPKKSVVVK 419
Kv7.2      -VSLKDRVFSSPRGVAAKGKGSPQA----QTVRRSPSADQSLEDSPSKVPKSWSFGDRSR 491
Kv7.3      -PS-KEPKPVGLNNKERFRTAF---------RMKAYAF---------WQSSEDAGTGDP 495
Kv7.4      -HRPGSTSFCP-GES-----------------SRM---------------GIKDRIR-- 441
Kv7.5      -KVQKSWSFND-RTRFRPSLRL----------KSSQPKP-------------VIDADTALG 495
Kv8.1      --SIFSTVEYF----------------AEQSIPDT-------------TFTSVPCAW 383
Kv8.2      ---TFSAAVYS----------------VEHDVPST-------------NFTTIPHSW 448
Kv9.1      -SVFSGVAYTA----------------EKEEDVGF-------------NTIPACW 412
Kv9.2      -SIFSVVAYTI----------------EKEENEGL-------------ATIPACW 365
Kv9.3      -SIFSVVAYTI----------------EKEENEGL-------------ATIPACW 365
Kv10.1     -IMMIGSLLYA--------------TIFGNVTTIFPQQ---------MYANTNRYHE 514
Kv10.2     -MMMVGSLLYA--------------TIFGNVTTIFPQQ---------MYANTNRYHE 483
Kv11.1     -VMLIGSLMYA--------------SIFGNVSAIIQRL---------YSGTARYHTQ 676
Kv11.2     -VMLIGSLMYA--------------SIFGNVSAIIQRL---------YSGTARYHTQ 528
Kv11.3     -VMLIGSLMYA--------------SIFGNVSAIIQRL---------YSGTARYHMQ 679
Kv12.1     -TMLIGALMHA--------------LVFGNVTAIIQR----------MYSRWSLYHT 485
Kv12.2     -TMLIGALMHA--------------VVFGNVTAIIQR----------MYARPFLYHS 516
Kv12.3     -TMLIGALMHA--------------VVFGNVTAIIQR----------MYSRPSLYHS 490
HCN1       -AMLSKLRFEV--------------FQPGDYIIRE------------GAVGKKMYF 514
HCN2       -AMLTKLKFEV--------------FQPGDYIIRE------------GTIGKKMYF 583
HCN3       -AVLTKLRFEV--------------FQPGDLVVRE------------GSVGRKMYF 467
HCN4       -SMLTKLRFEV--------------FQPGDYIIRE------------GTIGKKMYF 634
CatSper1   --STIRSRVTQ--------------MSKKVHTQDI------------STKHSEDWG 395
CatSper2   --ALTSSHSKI--------------EDRGASQQRE------------SLDLSEVSE 409
CatSper3   --MLEQQEMLM--------------GEKQVILQRQQEEI--------SPLMHIQ 312
CatSper4   -AMEIGGAIYF---------TIFITIGAFIGI--------------NLFVIVV 306
Hv1        --RLWRVARII--------------NGIII---------------SVKTRSE 225
KCa1.1     -KRIKKCGCKRLEDEQPSTLSPKK-----KQRNGGMRNSP--------NTSPKLMRH 734
KCa4.1     -----SGSRRPSIAPVLEL--------ADSSALLPCDLL--------SDQSEDEVTP 738
KCa4.2     -----KEIRRPSIAPVLEV--------ADTSSIQTCDLL--------SDQSEDETTP 657
TPC1       KERYRNVLDTMFELLPRMASLGLTLLIFYYSFAIVGMEFFCGIVFF----NCCNTSTVAD 677
```

Figure 15AQ

```
Shaker    W------WA---------------VVTM------------------------------ 440
Nav1.1    M------YA---------------AVDSRNVEL------------------------- 1449
Nav1.2    M------YA---------------AVDSRNVEL------------------------- 1439
Nav1.3    M------YA---------------AVDSRDVKL------------------------- 1434
Nav1.4    M------YA---------------AVDSREKEE------------------------- 1261
Nav1.5    M------YA---------------AVDSRGYEE------------------------- 1436
Nav1.6    M------YA---------------AVDSRKPDE------------------------- 1430
Nav1.7    M------YA---------------AVDSVNVDK------------------------- 1412
Nav1.8    M------YA---------------AVDSREVNM------------------------- 1384
Nav1.9    I------YA---------------AVDSTEKEQ------------------------- 1274
Cav1.1    A------ED-----------VGPIYNNRVEMAIFF----------------------I 1046
Cav1.2    T------ED-----------KGPIYNYRVEISIFF----------------------I 1118
Cav1.3    G------EN-----------IGPIYNHRVEISIFF----------------------I 1133
Cav1.4    A------ED-----------HGPIYNYRVEISVFF----------------------I 1107
Cav2.1    F------EN-----------QGPSPGYRMEMSIFY----------------------V 1495
Cav2.2    Y------EE-----------QGPSPGYRMELSIFY----------------------V 1397
Cav2.3    E------ED-----------PGPSRSNRMEMSIFY----------------------V 1385
Cav3.1    A------RA--------LRPDDPPLDGDDADDEG----------------NLSKGERVRAW 1239
Cav3.2    R------ID--------SHREDAAELDDDSEDSC----------------CLRLHKVLEPY 1261
Cav3.3    A------AGPAPGHEDCNGRMPSIAKDVFTKMGDRGDRGEDEEEIDYTLCFRVRKMIDVY 1102
Kv1.1     W------WA-----------------VVSM--------------------------- 370
Kv1.2     W------WA-----------------VVSM--------------------------- 372
Kv1.3     W------WA-----------------VVTM--------------------------- 442
Kv1.4     W------WA-----------------VVTM--------------------------- 522
Kv1.5     W------WA-----------------VVTM--------------------------- 478
Kv1.6     W------WA-----------------VVTM--------------------------- 420
Kv1.7     W------WA-----------------VVTM--------------------------- 356
Kv1.8     W------WA-----------------VVTM--------------------------- 419
Kv2.1     W------WA-----------------TITM--------------------------- 375
Kv2.2     W------WA-----------------TITM--------------------------- 379
Kv3.1     W------WA-----------------VVTM--------------------------- 398
Kv3.2     W------WA-----------------VVTM--------------------------- 435
Kv3.3     W------WA-----------------VVTM--------------------------- 501
Kv3.4     W------WA-----------------VVTM--------------------------- 434
Kv4.1     W------YT-----------------IVTM--------------------------- 370
Kv4.2     W------YT-----------------IVTM--------------------------- 368
Kv4.3     W------YT-----------------IVTM--------------------------- 365
Kv5.1     W------WAII---------------TM----------------------------- 368
Kv6.1     W------WA-----------------VITM--------------------------- 422
Kv6.2     W------WA-----------------VISM--------------------------- 367
Kv6.3     P------AA-----------------CWWVIIS------------------------ 370
Kv6.4     W------WA-----------------IISM--------------------------- 416
Kv7.1     K------KKF--------------KLDKDNGVTPGE--------------------- 435
Kv7.2     A------RQ---------------AFRIKGAAS------------------------ 503
Kv7.3     M------AE---------------DRGYGNDFF------------------------ 507
Kv7.4     -------M----------------GSSQRRT-------------------------- 449
Kv7.5     T------DD---------------VYDEKGCQC------------------------ 507
Kv8.1     W------WA-----------------TTSM--------------------------- 390
Kv8.2     W------WA-----------------AVSI---------------------------- 455
Kv9.1     W------WG-----------------TVSM--------------------------- 419
Kv9.2     W------WA-----------------TVSM--------------------------- 372
Kv9.3     W------WA-----------------TVSM--------------------------- 372
Kv10.1    M------LN---------------SVRDFLKLY------------------------ 526
Kv10.2    M------LN---------------NVRDFLKLY------------------------ 495
Kv11.1    M------LR---------------V-KEFIRFH------------------------ 687
Kv11.2    M------LR---------------V-KEFIRFH------------------------ 539
Kv11.3    M------LR---------------V-KEFIRFH------------------------ 690
Kv12.1    R------TK---------------DLKDFIRVH------------------------ 497
Kv12.2    R------TR---------------DLRDYIRIH------------------------ 528
Kv12.3    R------MK---------------DLKDFIRVH------------------------ 502
HCN1      I------QH---------------GVAGVIT-------------------------- 524
HCN2      I------QH---------------GVVSVLT-------------------------- 593
```

Figure 15AR

```
HCN3         I------QH--------------GLLSVLA---------------------------- 477
HCN4         I------QH--------------GVVSVLT---------------------------- 644
CatSper1     KEEGQFQKR--------------KTGRLQR---------------------------- 411
CatSper2     V------ES--------------NYGA------------------------------- 416
CatSper3     K----------------------NADC------------------------------- 317
CatSper4     T------TNLEQ-----------MMKAGEQGQQQ------------------------ 323
Hv1          RQLL-------------------RLKQ------------------------------- 233
KCa1.1       DPLLIPGNDQI------------DNMDSNVK--------------------------- 753
KCa4.1       S------DD--------EGLSVVEYVKGYPPNSP---------------YIGSSP---- 764
KCa4.2       D------EE--------MS-SNLEYAKGYPFYSP---------------YIGSSP---- 682
TPC1         A------YR--------------WRNH------------------------------- 684

Shaker       --------------------------------TTVGYGDMTP--------------- 450
Nav1.1       --------------------------------QPKYEESLYMYLYFV--------- 1464
Nav1.2       --------------------------------QPKYEDNLYMYLYFV--------- 1454
Nav1.3       --------------------------------QPVYEENLYMYLYFV--------- 1449
Nav1.4       --------------------------------QPQYEVNLYMYLYFV--------- 1276
Nav1.5       --------------------------------QPQWEYNLYMYIYFV--------- 1451
Nav1.6       --------------------------------QPKYEDNIYMYIYFV--------- 1445
Nav1.7       --------------------------------QPKYEYSLYMYIYFV--------- 1427
Nav1.8       --------------------------------QPKWEDNVYMYLYFV--------- 1399
Nav1.9       --------------------------------QPEFESNSLGYIYFV--------- 1289
Cav1.1       IYIILIAFFMMNIFVGFVIVTFQEQGETEYKNCELDKNQRQCVQYALKARPL------ 1098
Cav1.2       IYIIYIAFFMMNIFVGFVIVTFQEQGEQEYKNCELDKNQRQCVEYALKARPL------ 1170
Cav1.3       IYIIIVAFFMMNIFVGFVIVTFQEQGEKEYKNCELDKNQRQCVEYALKARPL------ 1185
Cav1.4       VYIIYIAFFMMNIFVGFVIITFRAQGEQEYQNCELDKNQRQCVEYALKAQPL------ 1159
Cav2.1       VYFVVFPFFFVNIFVALIIITFQEQGDKMMEEYSLEKNERACIDFAISAKPLT----- 1548
Cav2.2       VYFVVFPFFFVNIFVALIIITFQEQGDKVMSECSLEKNERACIDFAISAKPLT----- 1450
Cav2.3       VYFVVFPFFFVNIFVALIIITFQEQGDKMMEECSLEKNERACIDFAISAKPLT----- 1438
Cav3.1       IRARLPACCLERDSWSAYIFPPQSRFRLLCHRIITHKMFDHVVLVIIFLNCITIAMERPK 1299
Cav3.2       KPQW----CRSREAWALYLFSPQNRFRVSCQKVITHKMFDHVVLVFIFLNCVTIALERPD 1317
Cav3.3       KPDW----CEVREDWSVYLFSPENRFRVLCQTIIAHKLFDYVVLAFIFLNCITIALERPQ 1158
Kv1.1        ------------------------TTVGYGDMYP---------------- 380
Kv1.2        ------------------------TTVGYGDMVP---------------- 382
Kv1.3        ------------------------TTVGYGDMHP---------------- 452
Kv1.4        ------------------------TTVGYGDMKP---------------- 532
Kv1.5        ------------------------TTVGYGDMRP---------------- 488
Kv1.6        ------------------------TTVGYGDMYP---------------- 430
Kv1.7        ------------------------TTVGYGDMAP---------------- 366
Kv1.8        ------------------------TTVGYGDMCP---------------- 429
Kv2.1        ------------------------TTVGYGDIYP---------------- 385
Kv2.2        ------------------------TTVGYGDIYP---------------- 389
Kv3.1        ------------------------TTLGYGDMYP---------------- 408
Kv3.2        ------------------------TTLGYGDMYP---------------- 445
Kv3.3        ------------------------TTLGYGDMYP---------------- 511
Kv3.4        ------------------------TTLGYGDMYP---------------- 444
Kv4.1        ------------------------TTLGYGDMVP---------------- 380
Kv4.2        ------------------------TTLGYGDMVP---------------- 378
Kv4.3        ------------------------TTLGYGDMVP---------------- 375
Kv5.1        ------------------------TTVGYGDIYP---------------- 378
Kv6.1        ------------------------TTVGYGDMVP---------------- 432
Kv6.2        ------------------------TTVGYGDMVP---------------- 377
Kv6.3        -----------------------MTTVGYGDMYPI--------------- 382
Kv6.4        ------------------------TTVGYGDMVP---------------- 426
Kv7.1        ---------------------KMLTVPHITCDPPEE-------------- 450
Kv7.2        ------------RQNSEEASLP-GEDIVDDKSCPCEFVTEDLT-------- 533
Kv7.3        ------------IEDMIPTL---KAAIRAVRILQFRLYKKKFK-------- 535
Kv7.4        ------------------------GPSKQRLAPPT--------------- 460
Kv7.5        ----------DVSVEDLTPPLKTVIRAIRIMKFRVAKRKFK---------- 538
Kv8.1        ------------------------TTVGYGDIRP---------------- 400
Kv8.2        ------------------------STVGYGDMYPE--------------- 466
Kv9.1        ------------------------TTVGYGDVVP---------------- 429
```

Figure 15AS

```
Kv9.2        --------------------------------TTVGYGDVVP--------------- 382
Kv9.3        --------------------------------TTVGYGDVVP--------------- 382
Kv10.1       ------------------QVPKGLSERVMDYIVSTWSMSRGIDTEKVLQ--------------- 557
Kv10.2       ------------------QVPKGLSERVMDYIVSTWSMSKGIDTEKVLS--------------- 526
Kv11.1       ------------------QIPNPLRQRLEEYFQHAWSYTNGIDMNAVLK--------------- 718
Kv11.2       ------------------QIPNPLRQRLEEYFQHAWSYTNGIDMNAVLK--------------- 570
Kv11.3       ------------------QIPNPLRQRLEEYFQHAWTYTNGIDMNMVLK--------------- 721
Kv12.1       ------------------HLPQQLKQRMLEYFQTTWSVNNGIDSNELLK--------------- 528
Kv12.2       ------------------RIPKPLKQRMLEYFQATWAVNNGIDTTELLQ--------------- 559
Kv12.3       ------------------RLPRPLKQRMLEYFQTTWAVNSGIDANELLR--------------- 533
HCN1         ------------------------KSSKEMKLT-DGSYFG--------------- 539
HCN2         ------------------------KGNKEMKLS-DGSYFG--------------- 608
HCN3         ------------------------RGARDTRLT-DGSYFG--------------- 492
HCN4         ------------------------KGNKETKLA-DGSYFG--------------- 659
CatSper1     ---------------------------TRKKGHSTNLFQ--------------- 423
CatSper2     ---------------------------TEEDLITSASKTEE--------------- 430
CatSper3     ---------------------------TSFSELVENF--------------- 327
CatSper4     ---------------------------RITFSETGAEEEE--------------- 336
Hv1          -------------------------MNVQLAAKIQHLEF--------- 247
KCa1.1       -------------------------KYDSTGMFHWCAPKEIE--------- 770
KCa4.1       ------------TLCHLLPVKAPFCCLRLDKGCKHNSYED--------------- 792
KCa4.2       ------------TFCHLLHEKVPFCCLRLDKSCQHNYYED--------------- 710
TPC1         -----------------------------TVGNRTVVEE--------------- 694

Shaker       ----------------------------VGVWGKIV---------------GSLCAI---- 464
Nav1.1       -IFIIFGSFFTLNLFIGVIIDNFNQQKKKFGGQDIF---------MTEEQKKYYNA---- 1510
Nav1.2       -IFIIFGSFFTLNLFIGVIIDNFNQQKKKFGGQDIF---------MTEEQKKYYNA---- 1500
Nav1.3       -IFIIFGSFFTLNLFIGVIIDNFNQQKKKFGGQDIF---------MTEEQKKYYNA---- 1495
Nav1.4       -IFIIFGSFFTLNLFIGVIIDNFNQQKKKLGGQDIF---------MTEEQKKYYNA---- 1322
Nav1.5       -IFIIFGSFFTLNLFIGVIIDNFNQQKKKLGGQDIF---------MTEEQKKYYNA---- 1497
Nav1.6       -IFIIFGSFFTLNLFIGVIIDNFNQQKKKFGGQDIF---------MTEEQKKYYNA---- 1491
Nav1.7       -VFIIFGSFFTLNLFIGVIIDNFNQQKKKLGGQDIF---------MTEEQKKYYNA---- 1473
Nav1.8       -IFIIFGGFFTLNLFVGVIIDNFNQQKKKLGGQDIF---------MTEEQKKYYNA---- 1445
Nav1.9       -VFIIFGSFFTLNLFIGVIIDNFNQQKKLGGQDIF---------MTEEQKKYYNA---- 1335
Cav1.1       -----------RCYIPKNPYQ-YQVWYIVTSSYFEYLMFALIMLNTICLGMQHYNQSEQ 1145
Cav1.2       -----------RRYIPKNQHQ-YKVWYVVNSTYFEYLMFVLILLNTICLAMQHYGQSCL 1217
Cav1.3       -----------RRYIPKNPYQ-YKFWYVVNSSPFEYMMFVLIMLNTLCLAMQHYEQSKM 1232
Cav1.4       -----------RRYIPKNPHQ-YRVWATVNSAAFEYLMFLLILLNTVALAMQHYEQTAP 1206
Cav2.1       -----------RHMPQNKQSFQYRMWQFVVSPPFEYTIMAMIALNTIVLMMKFYGASVA 1596
Cav2.2       -----------RYMPQNRQSFQYKTWTFVVSPPFEYFIMAMIALNTVVMMKFYDAPYE 1498
Cav2.3       -----------RYMPQNRHTFQYRVWHFVVSPSFEYTIMAMIALNTVVLMMKYYSAPCT 1486
Cav3.1       IDPHSAERIFLTLSNYIFTAVFLAEMTVKVVALGWCFGEQAYLRSSWNVLDGLLVL---- 1355
Cav3.2       IDPGSTERVFLSVSNYIFTAIFVAEMMVKVVALGLLSGEHAYLQSSWNLLDGLLVL---- 1373
Cav3.3       IEAGSTERIFLTVSNYIFTAIFVGEMTLKVVSLGLYFGEQAYLRSSWNVLDGFLVF---- 1214
Kv1.1        ---------------------VTIGGKIV---------------GSLCAI---- 394
Kv1.2        ---------------------TTIGGKIV---------------GSLCAI---- 396
Kv1.3        ---------------------VTIGGKIV---------------GSLCAI---- 466
Kv1.4        ---------------------ITVGGKIV---------------GSLCAI---- 546
Kv1.5        ---------------------ITVGGKIV---------------GSLCAI---- 502
Kv1.6        ---------------------MTVGGKIV---------------GSLCAI---- 444
Kv1.7        ---------------------VTVGGKIV---------------GSLCAI---- 380
Kv1.8        ---------------------TTPGGKIV---------------GTLCAI---- 443
Kv2.1        ---------------------KTLLGKIV---------------GGLCCI---- 399
Kv2.2        ---------------------KTLLGKIV---------------GGLCCI---- 403
Kv3.1        ---------------------QTWSGMLV---------------GALCAL---- 422
Kv3.2        ---------------------QTWSGMLV---------------GALCAL---- 459
Kv3.3        ---------------------KTWSGMLV---------------GALCAL---- 525
Kv3.4        ---------------------KTWSGMLV---------------GALCAL---- 458
Kv4.1        ---------------------STIAGKIF---------------GSICSL---- 394
Kv4.2        ---------------------KTIAGKIF---------------GSICSL---- 392
Kv4.3        ---------------------KTIAGKIF---------------GSICSL---- 389
Kv5.1        ---------------------KTTLGKLN---------------AAISFL---- 392
```

Figure 15AT

```
Kv6.1       ------------------------------RSTFGQVV---------------ALSSIL---- 446
Kv6.2       ------------------------------RSLFGQVV---------------ALSSIL---- 391
Kv6.3       ------------------------------TVFGRIL----------------GGVCV----- 394
Kv6.4       ------------------------------RSVFGQMV---------------ALSSIL---- 440
Kv7.1       ------------------------------RRLDHFSVDGY------------DSSV------ 465
Kv7.2       -----------------------------P--GLKVSI---------------RAVCV----- 545
Kv7.3       ------------------------------ETLRPYDVK--------------DVIEQ----- 549
Kv7.4       ------------------------------MPTSPS-----------------SEQ------- 469
Kv7.5       ------------------------------ETLRPYDVK--------------DVIEQ----- 552
Kv8.1       ------------------------------DTTTGKIV---------------AFMCI----- 413
Kv8.2       ------------------------------THLGRFF----------------AFLCIAFGII 483
Kv9.1       ------------------------------VTVAGKLA---------------ASGCIL---- 443
Kv9.2       ------------------------------GTTAGKLF---------------ASACIL---- 396
Kv9.3       ------------------------------GTTAGKLF---------------ASACIL---- 396
Kv10.1      ------------------------------ICPKDMRAD-------------ICVHL----- 571
Kv10.2      ------------------------------ICPKDMRAD-------------ICVHL----- 540
Kv11.1      ------------------------------GFPECLQAD-------------ICLHL----- 732
Kv11.2      ------------------------------GFPECLQAD-------------ICLHL----- 584
Kv11.3      ------------------------------GFPECLQAD-------------ICLHL----- 735
Kv12.1      ------------------------------DFPDELRSD-------------ITMHL----- 542
Kv12.2      ------------------------------SLPDELRAD-------------IAMHL----- 573
Kv12.3      ------------------------------DFPDELRAD-------------IAMHL----- 547
HCN1        ------------------------------EICLLTRGR-------------RTAS------ 552
HCN2        ------------------------------EICLLTRGR-------------RTAS------ 621
HCN3        ------------------------------EICLLTRGR-------------RTAS------ 505
HCN4        ------------------------------EICLLTRGR-------------RTAS------ 672
CatSper1    ------------------------------WLWEKLTFLIQ-----------GFREMIRNLTQSL 447
CatSper2    ------------------------------TLSKKREYQ-------------SSSCVS---- 445
CatSper3    ------------------------------KKTLSH----------------TDPMVL---- 339
CatSper4    ------------------------------ENDQLPL---------------VHCVV----- 348
Hv1         ------------------------------SCSEKEQEIE------------RLNKLL---- 263
KCa1.1      ----------------------KVILTRSEAAMTVLSGHVVVCIF--------GDVSSALIGL 803
KCa4.1      ----------------------AKAYGFKNKLIIVSAETAGN----------GLYNFIVP--- 820
KCa4.2      ----------------------AKAYGFKNKLIIVAAETAGN----------GLYNFIVP--- 738
TPC1        ------------------------------GYYYLNNFDNIL----------NSFVTLFELT 716

Shaker      ---------AGVLTI---------ALPVPVIVSNFNYFYR-------RETDQE--------- 492
Nav1.1      ---------MKKLGSKKPQKPIPRPGNKFQGMVFDFVTRQ-------VFDISIMILI------ 1551
Nav1.2      ---------MKKLGSKKPQKPIPRPANKFQGMVFDFVTRQ-------VFDISIMILI------ 1541
Nav1.3      ---------MKKLGSKKPQKPIPRPANKFQGMVFDFVTRQ-------VFDISIMILI------ 1536
Nav1.4      ---------MKKLGSKKPQKPIPRPQNKIQGMVYDLVTRQ-------AFDITIMILI------ 1363
Nav1.5      ---------MKKLGSKKPQKPIPRPLNKYQGFIFDIVTRQ-------AFDVTIMFLI------ 1538
Nav1.6      ---------MKKLGSKKPQKPIPRPLNKIQGIVFDFVTQQ-------AFDIVIMMLI------ 1532
Nav1.7      ---------MKKLGSKKPQKPIPRPGNKIQGCIFDLVTNQ-------AFDISIMVLI------ 1514
Nav1.8      ---------MKKLGSKKPQKPIPRPLNKFQGFVFDIVTRQ-------AFDITIMVLI------ 1486
Nav1.9      ---------MKKLGSKKPQKPIPRPLNKCQGLVFDIVTSQ-------IFDIIIISLI------ 1376
Cav1.1      MNHISDILNVAFTIIFTLEMILKLMAFKARGYFGNPWNVF-DFLIVIGSIIDVILSEIDT 1204
Cav1.2      FKIAMNILNMLFTGLFTVEMILKLIAFKPKHYFCDAWNTF-DALIVVGSI-VDIAITEVN 1275
Cav1.3      FNDAMDILNMVFTGVPFTVEMLKVIAFKPKGYFSDAWNTF-DSLIVIGSI-IDVALSEAD 1290
Cav1.4      FNYAMDILNMVFTGLPTIEMVLKIIAFKPKHYFTDAWNTF-DALIVVGSI-VDIAVTEVN 1264
Cav2.1      YENALRVFNIVFTSLFSLECVLKVMAFGILNYFRDAWNIF-DFVTVLGSI-TDILVTEFG 1654
Cav2.2      YELMLKCLNIVFTSMFSMECVLKIIAFGVLNYFRDAWNVF-DFVTVLGSI-TDILVTEIA 1556
Cav2.3      YELALKYLNIAFTMVFSLECVLKVIAFGFLNYFRDTWNIF-DFITVIGSI-TEIILTDSK 1544
Cav3.1      ---------ISVIDILVSMV------SDSGTKILGMLRVLRLLRTLRPLRVISRAQGLKLV 1401
Cav3.2      ---------VSLVDIVVAMA------SAGGAKILGVLRVLRLLRTLRPLRVISRAPGLKLV 1419
Cav3.3      ---------VSIIDIVVSLA------SAGGAKILGVLRVLRLLRTLRPLRVISRAPGLKLV 1260
Kv1.1       ---------AGVLTI---------ALPVPVIVSNFNYFYR-------RETEGE--------- 422
Kv1.2       ---------AGVLTI---------ALPVPVIVSNFNYFYR-------RETEGE--------- 424
Kv1.3       ---------AGVLTI---------ALPVPVIVSNFNYFYR-------RETEGE--------- 494
Kv1.4       ---------AGVLTI---------ALPVPVIVSNFNYFYR-------RETENE--------- 574
Kv1.5       ---------AGVLTI---------ALPVPVIVSNFNYFYR-------RETDHE--------- 530
Kv1.6       ---------AGVLTI---------ALPVPVIVSNFNYFYR-------RETE----------- 470
```

Figure 15AU

```
Kv1.7       --------AGVLTI--------SLPVPVIVSNFSYFYH-------RETE---------- 406
Kv1.8       --------AGVLTI--------ALPVPVIVSNFNYFYH-------RETENE-------- 471
Kv2.1       --------AGVLVI--------ALPIPIIVNNFSEFYKEQKRQEKAIKRREALE------ 437
Kv2.2       --------AGVLVI--------ALPIPIIVNNFSEFYKEQKRQEKAIKRREALE------ 441
Kv3.1       --------AGVLTI--------AMPVPVIVNNFGMYYSLA------MAKQKL-------- 452
Kv3.2       --------AGVLTI--------AMPVPVIVNNFGMYYSLA------MAKQKL-------- 489
Kv3.3       --------AGVLTI--------AMPVPVIVNNFGMYYSLA------MAKQKL-------- 555
Kv3.4       --------AGVLTI--------AMPVPVIVNNFGMYYSLA------MAKQKL-------- 488
Kv4.1       --------SGVLVI--------ALPVPVIVSNFSRIYHQ------NQPAD---------- 422
Kv4.2       --------SGVLVI--------ALPVPVIVSNFSRIYHQ------NQPAD---------- 420
Kv4.3       --------SGVLVI--------ALPVPVIVSNFSRIYHQ------NQPAD---------- 417
Kv5.1       --------CGVIAIALPI----HPIINNFVRYYNKQRVLE-------------------- 420
Kv6.1       --------SGILLM--------AFPVTSIFHTFSRSYL-------ELKQEQ--------- 474
Kv6.2       --------SGILLM--------AFPVTSIFHTFSRSYS-------ELKEQQ--------- 419
Kv6.3       --------VSGIVL--------LALPITFIYHSFVQCYHEL------------------- 419
Kv6.4       --------SGILIM--------AFPATSIFHTFSHSYL-------ELKKEQ--------- 468
Kv7.1       --------RKSPTL----------LEVSMPHFMRTNSF------AEDLDLEGETLL---- 497
Kv7.2       --------MRFLVSKRKF--------KESLRPYDVMD---VIEQYSAGHLDMLS------ 580
Kv7.3       --------YSAGHLDMLS--------RIKYLQTRIDM---IFTPGPPSTPKHEK------ 584
Kv7.4       --------VGEAT-----------SPTKVQKSWSF------NDRTRFRASL-------- 495
Kv7.5       --------YSAGHLDMLC--------RIKSLQTRVDQILGKGQITSDKKSREKIT---- 591
Kv8.1       --------LSGILV--------LALPIAIINDRFSACYFTL-----KLKE--------- 442
Kv8.2       L-------NGMPIS--------ILYNKFSDYYSKLKA---------------------- 505
Kv9.1       --------GGILVV--------ALPITIIFNKFSHFYR-------RQKALE-------- 471
Kv9.2       --------AGILVV--------VLPITLIFNKFSHFYR-------RQKQLE-------- 424
Kv9.3       --------AGILVV--------VLPITLIFNKFSHFYR-------RQKQLE-------- 424
Kv10.1      --------NRKVFKEHPAF------RLASDGCLRALAMEFQTVHCAPGDLIYHAG----- 612
Kv10.2      --------NRKVFNEHPAF------RLASDGCLRALAVEFQTIHCAPGDLIYHAG----- 581
Kv11.1      --------NRSLLQHCKPF------RGATKGCLRALAMKFKTTHAPPGDTLVHAG----- 773
Kv11.2      --------HRALLQHCPGF------SGAGKGCLRALAVKFKTTHAPPGDTLVHLG----- 625
Kv11.3      --------NQTLLQNCKAF------RGASKGCLRALAMKFKTTHAPPGDTLVHCG----- 776
Kv12.1      --------NKEILQLSLF------ECASRGCLRSLSLHIKTSFCAPGEYLLRQG----- 582
Kv12.2      --------HKEVLQLPLF------EAASRGCLRALSLALRPAFCTPGEYLIHQG----- 613
Kv12.3      --------NREILQLPLF------GAASRGCLRALSLHIKTSFCAPGEYLLRPG----- 597
HCN1        --------VRADTYCRLY--------SLSV--DNFNE-------VLEEYPMMRRA---- 582
HCN2        --------VRADTYCRLY--------SLSV--DNFNE-------VLEEYPMMRRA---- 651
HCN3        --------VRADTYCRLY--------SLSV--DHFNA-------VLEEFPMMRRA---- 535
HCN4        --------VRADTYCRLY--------SLSV--DNFNE-------VLEEYPMMRRA---- 702
CatSper1    AFETFIFFVVCLNTVMLVAQTFAEVEIRGEWYFMALDSIF-------------------- 487
CatSper2    ------------------------STSSSYSSSSESRF------SESIG---------- 464
CatSper3    --------DDFGTSLPFI----------DIYFSTLDYQ---------------------- 359
CatSper4    --------ARSEKSGLLQEP----LAGGPLSNLSENTCD------NFCLVLEAIQE---- 386
Hv1         -------------------------RQHGLLGEVN------------------------- 273
KCa1.1      RNLVMPLRASNFHYHELK------HIVFVGSIEYLKREWETLHNFPKVSILPGTPLSRA 856
KCa4.1      --------LR------AYYR------SRKELNPIVLLLD---------NKPDHHFL---- 847
KCa4.2      --------LR------AYYR------PKKELNPIVLLLD---------NPPDMHFL---- 765
TPC1        --------VVNNWY------IIMEGVTSQTSHWSRLYFMTFYIVTMVVMTIIVAFILEAF 762

Shaker      ----------------------------------------------EMQSQNFNHVTSCP 506
Nav1.1      ----------------------------------------------CLNMVTMMVETDDQ 1565
Nav1.2      ----------------------------------------------CLNMVTMMVETDDQ 1555
Nav1.3      ----------------------------------------------CLNMVTMMVETDDQ 1550
Nav1.4      ----------------------------------------------CLNMVTMMVETDDQ 1377
Nav1.5      ----------------------------------------------CLNMVTMMVETDDQ 1552
Nav1.6      ----------------------------------------------CLNMVTMMVETDTQ 1546
Nav1.7      ----------------------------------------------CLNMVTMMVEKEGQ 1528
Nav1.8      ----------------------------------------------CLNMITMMVETDDQ 1500
Nav1.9      -----------------------------------------------ILNMISMMAESYNQ 1390
Cav1.1      FLASSGGLYCLGGGCGNVDP-----------------------DESARISSAFFRLF 1238
Cav1.2      -----------NAEE---------------------------------NSRISITFFRLF 1291
Cav1.3      PTESENVPVPTATFGNSEE-----------------------------SNRISITFFRLF 1321
Cav1.4      NGGHLGE-----------SSED--------------------------SSRISITFFRLF 1287\
```

Figure 15AV

```
Cav2.1      ------------------------------------NPNNFINLSFLRLF 1668
Cav2.2      ------------------------------------ETNNFINLSFLRLF 1570
Cav2.3      L-----------------------------------VNTSGFNMSFLKLF 1559
Cav3.1      VETLMSSLKPIGNIVVICCAFFIIFGILGVQLFKGKFFVCQGEDTRNITNKSDCAEASYR 1461
Cav3.2      VETLISSLRPIGNIVLICCAFFIIFGILGVQLFKGKFYYCEGPDTRNISTKAQCRAAHYR 1479
Cav3.3      VETLISSLKPIGNIVLICCAFFIIFGILGVQLFKGKFYHCLGVDTRNITNRSDCMAANYR 1320
Kv1.1       ---------------------------------------EQAQ-LLHV-SSPN 434
Kv1.2       ---------------------------------------EQAQ-YLQVTSCPK 437
Kv1.3       ---------------------------------------EQSQ-YMHVGSCQH 507
Kv1.4       ---------------------------------------EQTQLTQNAVSCPY 588
Kv1.5       ---------------------------------------EPAV---LKEEQGT 541
Kv1.6       ----------------------------------------------------
Kv1.7       ----------------------------------------------------
Kv1.8       ---------------------------------------EKQN---------- 475
Kv2.1       ---------------------------------------RAKRNGSIVSMNMK 451
Kv2.2       ---------------------------------------RAKRNGSIVSMNLK 455
Kv3.1       ---------------------------------------PKKKKHIPRPPQL 466
Kv3.2       ---------------------------------------PRKRKHIPPAPQA 503
Kv3.3       ---------------------------------------PKKNKHIPRPPQP 569
Kv3.4       ---------------------------------------PKKRKHVPRPAQL 502
Kv4.1       ---------------------------------------KRRAQQKVRLARIR 436
Kv4.2       ---------------------------------------KRRAQKKARLARIR 434
Kv4.3       ---------------------------------------KRRAQKKARLARIR 431
Kv5.1       ---------------------------------------TAAKHELELMEL 432
Kv6.1       ---------------------------------------ER----------- 476
Kv6.2       ---------------------------------------QRAASPEPA----- 428
Kv6.3       ----------------------------------------------------
Kv6.4       ---------------------------------------EQLQ---------- 472
Kv7.1       ---------------------------------------TPITHISQLREH 509
Kv7.2       ---------------------------------------RIKSLQSRVDQIVGRGPA 598
Kv7.3       ---------------------------------------SQKG--SAFTFPSQQSPR 600
Kv7.4       ---------------------------------------RLKPRTSAEDAPSEEV-- 511
Kv7.5       ---------------------------------------AEHETTDDLSMLGRVVKV 609
Kv8.1       ---------------------------------------AAVRQREALKKLT 455
Kv8.2       ---------------------------------------YEYTTIRRERGE 517
Kv9.1       ---------------------------------------AAVRNS-------- 477
Kv9.2       ---------------------------------------SAMRSCDF------ 432
Kv9.3       ---------------------------------------SAMRSCDF------ 432
Kv10.1      ---------------------------------------ESVDSLCFVVSGSLE 627
Kv10.2      ---------------------------------------ESVDALCFVVSGSLE 596
Kv11.1      ---------------------------------------DLLTALYFISRGSIE 788
Kv11.2      ---------------------------------------DVLSTLYFISRGSIE 640
Kv11.3      ---------------------------------------DVLTALYFLSRGSIE 791
Kv12.1      ---------------------------------------DALQAIYFVCSGSME 597
Kv12.2      ---------------------------------------DALQALYFVCSGSME 628
Kv12.3      ---------------------------------------DALQAHYYVCSGSLE 602
HCN1        ---------------------------------------FETVAIDRLDRIGKKNSI 600
HCN2        ---------------------------------------FETVAIDRLDRIGKKNSI 669
HCN3        ---------------------------------------FETVAMDRLLRIGKKNSI 553
HCN4        ---------------------------------------FETVALDRLDRIGKKNSI 720
CatSper1    ---------------------------------------FCIYVVEALLKIIAL 502
CatSper2    ---------------------------------------RLDWETLVHENLPG 478
CatSper3    ----------------------------------------------------
CatSper4    ---------------------------------------NLRQYKEIRDELNMIV 402
Hv1         ----------------------------------------------------
KCa1.1      ---------------------------------------DLRAVNINLCDMCVIL 872
KCa4.1      -----------EAICCFPMV-------------------YYMEGSVDNLDS 868
KCa4.2      -----------DAICWFPMV-------------------YYMVGSIDNLDD 786
TPC1        ---------------------------------------VFRMNYSRKNQDSE 776
```

Figure 15AW

```
Shaker   YLPGTLGQ--------------HMKK-----SSLSE---------------------SSSD-  527
Nav1.1   SEYVTTILSR---INLVFIVLFTGE-----CVLKLIS------------LRHYYFTIGWNI  1606
Nav1.2   SQEMTNILYW---INLVFIVLFTGE-----CVLKLIS------------LRYYYFTIGWNI  1596
Nav1.3   GKYMTLVLSR---INLVFIVLFTGE-----FVLKLVS------------LRHYYFTIGWNI  1591
Nav1.4   SQLKVDILYN---INMIFIIIFTGE-----CVLKMLA------------LRQYYFTVGWNI  1418
Nav1.5   SPEKINILAK---INLLFVAIFTGE-----CIVKLAA------------LRHYYFTNSWNI  1593
Nav1.6   SKQMENILYW---INLVFIVLFTGE-----CVLKMFA------------LRHYYFTIGWNI  1587
Nav1.7   SQHMTEVLYW---INVVFIILFTGE-----CVLKLIS------------LRHYYFTVGWNI  1569
Nav1.8   SEEKTKILGK---INQFFVAVFTGE-----CVMKMFA------------LRQYYFTNGWNV  1541
Nav1.9   PKAMKSILDH---LNWVFVVIFTLE-----CLIKIFA------------LRQYYFTNGWNL  1431
Cav1.1   RVMRLIKLLSRAEGVRTLLWTFIKSFQALPYVALLIVMLFFIYAVIGMQMFGKIALVDGT   1298
Cav1.2   RVMRLVKLLSRGEGIRTLLWTFIKSFQALPYVALLIVMLFFIYAVIGMQVFGKIALNDTT   1351
Cav1.3   RVMRLVKLLSRGEGIRTLLWTFIKFFQALPYVALLIAMLFFIYAVIGMQMFGKVAMRDNN   1381
Cav1.4   RVMRLVKLLSKGEGIRTLLWTFIKSFQALPYVALLIAMIFFIYAVIGMQMFGKVALQDGT   1347
Cav2.1   RAARLIKLLRQGYTIRILLWTFVQSFKALPYVCLLIAMLFFIYAIIGMQVFGNIGIDVED   1728
Cav2.2   RAARLIKLLRQGYTIRILLWTFVQSFKALPYVCLLIAMLFFIYAIIGMQVFGNIALDDDT   1630
Cav2.3   RAARLIKLLRQGYTIRILLWTFVQSFKALPYVCLLIAMLFFIYAIIGMQVFGNIKLDEES   1619
Cav3.1   WVRHKYNFDNLGQALMSLFVLASKD-----GWVDIM-------------YDGLDAVGVDQ   1503
Cav3.2   WVRHKYNFDNLGQALMSLFVLSSKD-----GWVNIM-------------YDGLDAVGVDQ   1521
Cav3.3   WVHHKYNFDNLGQALMSLFVLASKD-----GWVNIM-------------YNGLDAVAVDQ   1362
Kv1.1    LASDSDL---------------SRR-----SS-ST------------------MSKS-   452
Kv1.2    IPSSPDL---------------KKS-----RSAST------------------ISKS-   456
Kv1.3    L-SSSAEE--------------LRKA----RSNST------------------LSKS-   527
Kv1.4    LPSNLLKK--------------FRSS----TSSSL------------------GDKS-   609
Kv1.5    QSQGPGLD--------------RGVQ----RKVSG------------------SRGS-   562
Kv1.6    ----------------------QEE-----QGQYT------------------HVTC-   482
Kv1.7    ----------------------GEE-----AGMFS------------------HVDM-   418
Kv1.8    -------I--------------PGEI----ERILN------------------SVGS-   489
Kv2.1    DAFARSIEMM---DIVVEKNGENMG-----KKDKV------------QDNHLSPNKWK-   489
Kv2.2    DAFARSMELI---DVAVEKAGESAN-----TKDSA------------DDNHLSPSRWK-   493
Kv3.1    GSPNYCK---------------SVV-----NSPH-------------------HSTQ-   484
Kv3.2    SSPTFCKTEL------------NMAC----NSTQ-------------------SDTC-   525
Kv3.3    GSPNYCKPDP---PPPPPHPHHGS-----GGISPP------------PPITPPSM---   605
Kv3.4    ESPMYCK---------------SEE-----TSPR-------------------DSTC-   520
Kv4.1    LAKSGT--------TNAFLQYKQNGG-----LEDS--------------GSGEEQALCV-  468
Kv4.2    AAKSGS--------ANAYMQSK-RNG-----LLSNQLQ-----------SSEDEQAFVSK-  469
Kv4.3    VAKTGS--------SNAYLHSK-RNG-----LLNEALE-----------LTGTPEEEHMG-  466
Kv5.1    ----------------------NSS-----SGGE-------------------GKTG-   443
Kv6.1    ----------------------VMF-----RRAQF------------------LIKTK-  489
Kv6.2    ----------------LQEDST--------HS---------------------ATA-   439
Kv6.3    ----------------------KFR-----SA---------------------RYS-   427
Kv6.4    ----------------------APL-----RH--------------------LQNTG-  482
Kv7.1    HRATIKVI--------------RPMQYF--VAKKKFQQ-----------ARKPYDVRDVI  542
Kv7.2    ITDKDRTKGP------AEAELFEDPS-----MMGRLG------------KVEKQVLSME-  634
Kv7.3    NEPYVARPST------SEI---EDQS-----MMGKFV------------KVERQVQDMG-  633
Kv7.4    ----------------AEEKS-----YQCEL------------------TVDDIMPAVK- 531
Kv7.5    EKQVQSIESKLDCLLDIYQQVLRKG-----SASALALASFQIPPFECEQTSDYQSPVDS- 663
Kv8.1    KNIAT-----------------DSYI----SVNL-------------------PDVYA-  473
Kv8.2    VNFMQRA---------------RKKI--------------------------AECL   532
Kv9.1    ----------------------NHQ-----EFEDL------------------LSSID-  490
Kv9.2    ----------------------GDG-----MKEVP------------------SVNLR-  445
Kv9.3    ----------------------GDG-----MKEVP------------------SVNLR-  445
Kv10.1   VIQDDEVVAI------------LGKG----DVFGDVF-----------WKEATLAQSC-  658
Kv10.2   VIQDDEVVAI------------LGKG----DVFGDIF-----------WKETTLAHAC-  627
Kv11.1   ILRGDVVVAI------------LGKN----DIFGEP------------LNLYARPGKSN-  819
Kv11.2   ILRDDVVVAI------------LGKN----DIFGEP------------VSLHAQPGKSS-  671
Kv11.3   ILKDDIVVAI------------LGKN----DIFGEM------------VHLYAKPGKSN-  822
Kv12.1   VLKDSMVLAI------------LGKG----DLIGANL---------SIKDQ---VIKTN-  628
Kv12.2   VLKGGTVLAI------------LGKG----DLIGCEL---------PRRE--QVVKAN-  659
Kv12.3   VLRDNMVLAI------------LGKG----DLIGADIPEPGQE--PGLGADPNFVLKTS-  643
HCN1     LLQKFQK---------------DLNTG---VFNNQE-------------NEILKQIVKH-  628
HCN2     LLHKVQH---------------DLNSG---VFNNQE-------------NAIIQEIVKY-  697
HCN3     LQRKR-S---------------EPSPG---S----------------------S-      566
```

Figure 15AX

```
HCN4       LLHKVQH-------------DLNSG------VFNYQE-------------NEIQQIVQH- 748
CatSper1   GLSYFFDF-------------WNNLDFFIMAMAVL-------------DFLLMQTHSF 534
CatSper2   LMEMDQD--------------DRV-------------------------WPRDSL 494
CatSper3   ---------------------DTT-------------------------VHKL 366
CatSper4   EEVRAIRFNQEQ---------ESEVL----NRRS---------------STS- 426
Hv1        ----------------------------------------------------
KCa1.1     SANQNNIDDTSLQDKECILASLNIKSMQFDDSIGVLQA----------NSQGFTPPGMDR- 922
KCa4.1     LLQCGIIYAD-----------NLV-----VVDKES-------------TMS-AEEDYM- 896
KCa4.2     LLRCGVTFAA-----------NMV-----VVDKES-------------TMS-AEEDYM- 814
TPC1       V--------------------DGGITLEKEISKEEL-------------VAVL 796

Shaker     --MM--------DLDDGVESTPGLTETHPGRSAVAPFLGAQQ----------------- 559
Nav1.1     F-DF--------VVVILSIVGMFLAELIEK--------------------------- 1627
Nav1.2     F-DF--------VVVILSIVGMFLAELIEK--------------------------- 1617
Nav1.3     F-DF--------VVVILSIVGMFLAEMIEK--------------------------- 1612
Nav1.4     F-DF--------VVVILSIVGLALSDLIQK--------------------------- 1439
Nav1.5     F-DF--------VVVILSIVGTVLSDIIQK--------------------------- 1614
Nav1.6     F-DF--------VVVILSIVGMFLADIIEK--------------------------- 1608
Nav1.7     F-DF--------VVVIISIVGMFLADLIET--------------------------- 1590
Nav1.8     F-DF--------IVVVLSIASLIFSAILKSLQ------------------------ 1564
Nav1.9     F-DC--------VVVLLSIVSTMISTLENQEH------------------------ 1454
Cav1.1     QINR--------NNNFQTFPQAVLLLFRCATGEAWQEILLACSYGKLCDPES-------- 1342
Cav1.2     EINR--------NNNFQTFPQAVLLLFRCATGEAWQDIMLACMPGKKCAPESE------- 1396
Cav1.3     QINR--------NNNFQTFPQAVLLLFRCATGEAWQEIMLACLPGKLCDPES-------- 1425
Cav1.4     QINR--------NNNFQTFPQAVLLLFRCATGEAWQEIMLASLPGNRCDPES-------- 1391
Cav2.1     EDSDEDEFQITEHNNFRTFFQALMLLFRSATGEAWHNIMLSCLSGKPC----D------- 1777
Cav2.2     SINR--------HNNFRTFLQALMLLFRSATGEAWHEIMLSCLSNQAC----D------- 1671
Cav2.3     HINR--------HNNFRSFFGSLMLLFRSATGEAWQEIMLSCLGEKGCEPDTT------- 1664
Cav3.1     QPIM--------NHNPWMLLYFISFLLIVAFFVLNMFVGVVVENFHKCRQHQEEEEARRR 1555
Cav3.2     QPVQ--------NHNPWMLLYFISFLLIVSFFVLNMFVGVVVENFHKCRQHQEAEEEARRR 1573
Cav3.3     QPVT--------NHNPWMLLYFISFLLIVSFFVLNMFVGVVVENFHKCRQHQEAEEEARRR 1414
Kv1.1      --EY--------MEIEED--------------------------------------- 460
Kv1.2      --DY--------MEIQEG--------------------------------------- 464
Kv1.3      --EY--------MVIEEG--------------------------------------- 535
Kv1.4      --EY--------LEMEEG--------------------------------------- 617
Kv1.5      --FC--------KAGGTL--------------------------------------- 570
Kv1.6      --GQ--------PAPDLR--------------------------------------- 490
Kv1.7      --QP--------CGPLEG--------------------------------------- 426
Kv1.8      --RM--------G-------------------------------------------- 492
Kv2.1      --WT--------KRTLSETSSS--KSFETKEQGSPEKARS-------SSSPQHLNVQQLE 530
Kv2.2      --WA--------RKALSETSSN--KSFENKYQEVSQKDSHEQLNNTSSSPQHLSAQKLE 541
Kv3.1      --SD--------TCP------------------------------------------ 489
Kv3.2      --LG--------KDNRLLEH-------------------------------------- 535
Kv3.3      --GV--------TVA------------------------------------------ 610
Kv3.4      --SD--------TSPPAREE-------------------------------------- 530
Kv4.1      --RN--------PSAFEQQHHHLLHCLEKT---------------------------- 488
Kv4.2      --SG--------SSFETQ-HHHLLHCLEKT---------------------------- 488
Kv4.3      --KT--------TSLIESQHHHLLHCLEKT---------------------------- 486
Kv5.1      --GS--------RSDLDNLPPEP----------------------------------- 456
Kv6.1      --SQ--------LSV------------------------------------------- 494
Kv6.2      --TE--------DSS--Q---------------------------------------- 445
Kv6.3      --RSL-------STEFLN---------------------------------------- 436
Kv6.4      --PA--------SECELL---------------------------------------- 490
Kv7.1      EQYSQG------HLNLMV---------------------------------------- 554
Kv7.2      --KK--------LDFLVN----------IY--MQRMGIPPTETEAYFGA---------KEP 664
Kv7.3      --KK--------LDFLVD----------MH--MQHME--------RLQVQ---------V-- 654
Kv7.4      --TV--------IRSIRI----------LKFLVAKRK-----FKETLRP---------- 555
Kv7.5      --KD--------LSGSAQ----------NSG-CLSRS------TSANISR--------GLQ 689
Kv8.1      --RSI-------MEMLRL---------------------------------------- 482
Kv8.2      LGSNPQL-----TPRQEN---------------------------------------- 545
Kv9.1      --GV--------SEASLE---------------------------------------- 498
Kv9.2      --DY--------YAHKV----------------------------------------- 452
```

Figure 15AY

```
Kv9.3       --DY---------YAHKV------------------------------------- 452
Kv10.1      --AN---------VRALTY----------CDLHVIKRDALQKVLEFYTAF--------SHS 690
Kv10.2      --AN---------VRALTY----------CDLHIIKREALLKVLDFYTAF--------ANS 659
Kv11.1      --GD---------VRALTY----------CDLHKIHRDDLLEVLDMYPEF--------SDH 851
Kv11.2      --AD---------VRALTY----------CDLHKIQRADLLEVLDMYPAF--------AES 703
Kv11.3      --AD---------VRALTY----------CDLHKIQREDLLEVLDMYPEF--------SDH 854
Kv12.1      --AD---------VKALTY----------CDLQCIILKGLFEVLDLYPEY--------AHK 660
Kv12.2      --AD---------VKGLTY----------CVLQCLQLAGLHDSLALYPEF--------APR 691
Kv12.3      --AD---------VKALTY----------CGLQQLSSRGLAEVLRLYPEY--------GAA 675
HCN1        --DR---------EMVQAI----------AFINYPQMTTL----NSTSST--------TTP 656
HCN2        --DR---------EMVQQA----------ELGQRVGLFPP----PPPPPQ--------VTS 725
HCN3        --GG---------IMEQHL----------VQH-DRDMA-------------------- 582
HCN4        --DR---------EMAHCA----------HRVQAAASATP----TPTPVI--------WTP 776
CatSper1    AIYHQSLFRIL--KVFKS------------------------------------- 550
CatSper2    F-RYFELLEKLQYNLEER------------------------------------- 511
CatSper3    QELY---------YEIV-------------------------------------- 374
CatSper4    --GSLET-----TS------------------------------------------ 433
Hv1         ------------------------------------------------------- 
KCa1.1      --SSP--------DNSPVH-------------------------------------- 931
KCa4.1      --AD---------AKTIVN------------VQTMFRLFPSLSITTEL---------- 921
KCa4.2      --AD---------AKTIVN------------VQTLFRLFSSLSIITEL---------- 839
TPC1        ELYRE--------ARGASS-------------------------------------- 807

Shaker      ------------------------------------------------------- 
Nav1.1      ------------------------------------------------------- 
Nav1.2      ------------------------------------------------------- 
Nav1.3      ------------------------------------------------------- 
Nav1.4      ------------------------------------------------------- 
Nav1.5      ------------------------------------------------------- 
Nav1.6      ------------------------------------------------------- 
Nav1.7      ------------------------------------------------------- 
Nav1.8      ------------------------------------------------------- 
Nav1.9      ------------------------------------------------------- 
Cav1.1      ------------------------------------DYAPGEEYTCGTNFAYYYFIS 1363
Cav1.2      ------------------------------------PSNSTEGETPCGSSFAVFYFIS 1418
Cav1.3      ------------------------------------DYNPGEEHTCGSNFAIVYFIS 1446
Cav1.4      ------------------------------------DFGPGEEFTCGSNFAIAYFIS 1412
Cav2.1      ------------------------------------K-NSGILTRECGNEFAYFYFVS 1798
Cav2.2      ------------------------------------EQANATE---CGSDFAYFYFVS 1690
Cav2.3      ------------------------------------APSGQNENERCGTDLAYVYFVS 1686
Cav3.1      EEKRLRRLEKKRRPNLMLDD-VIASGSSASAASEAQCKPYYSDYSRFRLLVHHLCTSHYLD 1614
Cav3.2      EEKRLRRLEPRRRSTFPSPEAQRPPYYA---------DYSPTRRSI---HSLCTSHYLD 1620
Cav3.3      EEKRLRRLEKKRRPK------AQRLPYYA---------TYCHTRLLI---HSMCTSHYLD 1455
Kv1.1       ------------------------------------------------------- 
Kv1.2       ------------------------------------------------------- 
Kv1.3       ------------------------------------------------------- 
Kv1.4       ------------------------------------------------------- 
Kv1.5       ------------------------------------------------------- 
Kv1.6       ------------------------------------------------------- 
Kv1.7       ------------------------------------------------------- 
Kv1.8       ------------------------------------------------------- 
Kv2.1       DMYN-------KMAKTQSQPILNTKESAAQSKPKEELEMESIPSPVAPL---------- 572
Kv2.2       MLYNEITKTQPHSHPNPDCQEKPERPSAYEEEIEMEEVVCPQEQLAVAQ---------- 590
Kv3.1       ------------------------------------------------------- 
Kv3.2       ------------------------------------------------------- 
Kv3.3       ------------------------------------------------------- 
Kv3.4       ------------------------------------------------------- 
Kv4.1       --TCHE--------------------------------------------------- 492
Kv4.2       --TN----------------------------------------------------- 490
Kv4.3       --TGL---------------------------------------------------- 489
Kv5.1       ------------------------------------------------------- 
Kv6.1       ------------------------------------------------------- 
```

Figure 15AZ

```
Kv6.2     ------------------------------------------------------
Kv6.3     ------------------------------------------------------
Kv6.4     ------------------------------------------------------
Kv7.1     ------------------------------------------------------
Kv7.2     EP---APP---------------------YHSPEDS-------------- 676
Kv7.3     -----------------------------TEYYPTK-------------- 661
Kv7.4     -----------------------------YDVK-DVI------------- 562
Kv7.5     FILTPNEF---------------------SAQTFYAL------------- 705
Kv8.1     ------------------------------------------------------
Kv8.2     ------------------------------------------------------
Kv9.1     ------------------------------------------------------
Kv9.2     ------------------------------------------------------
Kv9.3     ------------------------------------------------------
Kv10.1    FSRNLIL----------------------TYNLRK--------------- 703
Kv10.2    FSRNLTL----------------------TCNLRK--------------- 672
Kv11.1    FWSSLEI----------------------TPNLRD--------------T 865
Kv11.2    FWSKLEV----------------------TPNLRD--------------- 716
Kv11.3    FLTNLEL----------------------TPNLRHESA-----------K 871
Kv12.1    FVEDIQH----------------------DLTYNL--------------- 673
Kv12.2    FSRGLRGE---------------------LSYNLGA-------------- 706
Kv12.3    FRAGLPR----------------------DLTFNL--------------- 688
HCN1      T------S---------------------RMRTQSPP------------- 666
HCN2      AIATLQQA---------------------AAMSFCPQ------------- 741
HCN3      -------R---------------------GVR------------------ 586
HCN4      LIQAPLQA---------------------AAATTSVAIAL-----THHPRL 801
CatSper1  ------------------------------------------------------
CatSper2  ------------------------------------------------------
CatSper3  ------------------------------------------------------
CatSper4  ------------------------------------------------------
Hv1       ------------------------------------------------------
KCa1.1    ------------------------------------------------------
KCa4.1    -----------------------------THPSNMRFM------------ 930
KCa4.2    -----------------------------THPANMRFM------------ 848
TPC1      ------------------------------------------------------

Shaker    ------------------------------------------------------
Nav1.1    ------------------------------------------------------
Nav1.2    ------------------------------------------------------
Nav1.3    ------------------------------------------------------
Nav1.4    ------------------------------------------------------
Nav1.5    ------------------------------------------------------
Nav1.6    ------------------------------------------------------
Nav1.7    ------------------------------------------------------
Nav1.8    ------------------------------------------------------
Nav1.9    ------------------------------------------------------
Cav1.1    FYMLCAFLVINLFVAVIM-------------------------------- 1381
Cav1.2    FYMLCAFLIINLFVAVIM-------------------------------- 1436
Cav1.3    FYMLCAFLIINLFVAVIM-------------------------------- 1464
Cav1.4    FPMLCAFLIINLFVAVIM-------------------------------- 1430
Cav2.1    FIFLCSFLMLNLFVAVIM-------------------------------- 1816
Cav2.2    FIFLCSFLMLNLFVAVIM-------------------------------- 1708
Cav2.3    FIFFCSFLMLNLFVAVIM-------------------------------- 1704
Cav3.1    LFITGVIGLNVVTMAMEHYQQPQILDEALKICNYIFTVIFVLESVFKLVAFGFRPFFQDR 1674
Cav3.2    LFITFIICVNVITMSMEHYNQPKSLDEALKYCNYVFTIVFVFEAALKLVAFGFRPFFKDR 1680
Cav3.3    IFITFIICLNVVTMSLEHYNQPTSLETALKYCNYMFTTVFVLEAVLKLVAFGLRPFFKDR 1515
Kv1.1     ------------------------------------------------------
Kv1.2     ------------------------------------------------------
Kv1.3     ------------------------------------------------------
Kv1.4     ------------------------------------------------------
Kv1.5     ------------------------------------------------------
Kv1.6     ------------------------------------------------------
Kv1.7     ------------------------------------------------------
```

Figure 15BA

```
Kv1.8      ----------------------------------------------------
Kv2.1      ----------------------------------------------------
Kv2.2      ----------------------------------------------------
Kv3.1      ----------------------------------------------------
Kv3.2      ----------------------------------------------------
Kv3.3      ----------------------------------------------------
Kv3.4      ----------------------------------------------------
Kv4.1      ----------------------------------------------------
Kv4.2      ----------------------------------------------------
Kv4.3      ----------------------------------------------------
Kv5.1      ----------------------------------------------------
Kv6.1      ----------------------------------------------------
Kv6.2      ----------------------------------------------------
Kv6.3      ----------------------------------------------------
Kv6.4      ----------------------------------------------------
Kv7.1      ----------------------------------------------------
Kv7.2      ------REHVDRHGCIV----------------------------------- 687
Kv7.3      ------G-TSSPAEAEK----------------------------------- 671
Kv7.4      ------EQYSAG---------------------------------------- 568
Kv7.5      ------SPTMHSQATQV----------------------------------- 716
Kv8.1      ----------------------------------------------------
Kv8.2      ----------------------------------------------------
Kv9.1      ----------------------------------------------------
Kv9.2      ----------------------------------------------------
Kv9.3      ----------------------------------------------------
Kv10.1     ------RIVFRKISDVKREEEE------------------------------ 719
Kv10.2     ------RIIFRKISDVKKEEEE------------------------------ 688
Kv11.1     NMIPGSPGSTELEGGFSR---------------------------------- 883
Kv11.2     --------AAGGLHSSPR---------------------------------- 726
Kv11.3     ADLLRSQSMNDSEGDNCK---------------------------------- 889
Kv12.1     ----REGHESDVISRLSN---------------------------------- 687
Kv12.2     ----GGGSAEVDTSSLSG---------------------------------- 720
Kv12.3     ----RQGSDTSGLSRFSR---------------------------------- 702
HCN1       --------VYTATSLSH------------------------------------ 675
HCN2       ----------VARPLV------------------------------------ 747
HCN3       ----------GRAPST------------------------------------ 592
HCN4       PAAIFRPPPGSGLGNLGAGQTPRHLKRLQSLIPSAL---------------- 837
CatSper1   ----------------------------------------------------
CatSper2   ----------------------------------------------------
CatSper3   ----------------------------------------------------
CatSper4   ----------------------------------------------------
Hv1        ----------------------------------------------------
KCa1.1     ----------------------------------------------------
KCa4.1     ----------QFRAKDSYSLAL-----------------SKLEKRE 949
KCa4.2     ----------QFRAKDCYSLAL-----------------SKLEKKE 867
TPC1       ----------------------------------------------------

Shaker     -----------------------------QQQQQPVASSLSMSIDKQLQHPL 582
Nav1.1     -----------------------------YFVSPTLFRVIRLARIGRILRLIKG 1652
Nav1.2     -----------------------------YFVSPTLFRVIRLARIGRILRLIKG 1642
Nav1.3     -----------------------------YFVSPTLFRVIRLARIGRILRLIKG 1637
Nav1.4     -----------------------------YFVSPTLFRVIRLARIGRVLRLIRG 1464
Nav1.5     -----------------------------YFFSPTLFRVIRLARIGRILRLIRG 1639
Nav1.6     -----------------------------YFVSPTLFRVIRLARIGRILRLIKG 1633
Nav1.7     -----------------------------YFVSPTLFRVIRLARIGRILRLVKG 1615
Nav1.8     -----------------------------SYFSPTLFRVIRLARIGRILRLIRA 1589
Nav1.9     -----------------------------IPFPPTLFRIVRLARIGRILRLVRA 1479
Cav1.1     -----------------------------DNFDYLTRDWSILGPHHLDEFKAI 1405
Cav1.2     -----------------------------DNFDYLTRDWSILGPHHLDEFKRI 1460
Cav1.3     -----------------------------DNFDYLTRDWSILGPHHLDEFKRI 1488
Cav1.4     -----------------------------DNFDYLTRDWSILGPHHLDEFKRI 1454
Cav2.1     -----------------------------DNFEYLTRDSSILGPHHLDEYVRV 1840
```

Figure 15BB

```
Cav2.2    ------------------------------------DNFEYLTRDSSILGPHHLDEFIRV 1732
Cav2.3    ------------------------------------DNFEYLTRDSSILGPHHLDEFVRV 1728
Cav3.1    WNQLDLAIVLLSIMGITLEEIEVNASLPINPTIIRIMRVLRIARVLKLLKMAVGMRALLD 1734
Cav3.2    WNQLDLAIVLLSLMGITLEEIEMSAALPINPTIIRIMRVLRIARVLKLLKMATGMRALLD 1740
Cav3.3    WNQLDLAIVLLSVMGITLEEIEINAALPINPTIIRIMRVLRIARVLKLLKMATGMRALLD 1575
Kv1.1     -----------------------------------------MNNS-IA----------  466
Kv1.2     -----------------------------------------VNNS-NE----------  470
Kv1.3     -----------------------------------------GMNH-SAFPQ-------  544
Kv1.4     -----------------------------------------VKESLCA----------  624
Kv1.5     -----------------------------------------ENADSARRGS-------  580
Kv1.6     -----------------------------------------ATDNGLGKP-------  499
Kv1.7     -----------------------------------------KANGGLVDGE-------  436
Kv1.8     -----------------------------------------STDS-------------  496
Kv2.1     ----------------------------------PTRTEGVIDMRSMSSIDSFISCATD 597
Kv2.2     ------------------------------------TEVIVDMKSTSSIDSFTSCATD 612
Kv3.1     ----------------------------------------LAQEEYLEIN--------  499
Kv3.2     ---------------------------------NRSVLSGDDSTGSEPPLSPPERL   558
Kv3.3     ---------------------------------GAYPAGPHTHPGLLRGGAGGLGI   633
Kv3.4     ---------------------------------GMIERKRADSKQNGDANAVLSDE   553
Kv4.1     -------------------------------------FTDELTFSEALGAVSPGG   510
Kv4.2     ----------------------------------HEFVDEQ-VFEESCMEV       506
Kv4.3     ----------------------------------SYLVD---DPLLSVRTS       503
Kv5.1     ----------------------------------------AGKEAPS-----------  463
Kv6.1     ----------------------------------------SQDS--------------  498
Kv6.2     ----------------------------------------GPDS--------------  449
Kv6.3     ----------------------------------------------------------
Kv6.4     ----------------------------------------DPHV--------------  494
Kv7.1     -----------------------------------RIKELQRRLDQSIGKPSLFIS--  575
Kv7.2     ----------------------------------KIVRSS---SSTGQK-NFSAPPAAPP 709
Kv7.3     ----------------------------------KEDNRY---SDLKTIICNYSETGPPE 694
Kv7.4     ---------------------------------------HL---DMLG---RIKSLQ----  580
Kv7.5     ---------------------------------PISQSD---GSAV----AATNTIANQI 736
Kv8.1     ----------------------------------------KGRER-------------  487
Kv8.2     ----------------------------------------------------------
Kv9.1     ----------------------------------------TS----------------  500
Kv9.2     ----------------------------------------KSLM--------------  456
Kv9.3     ----------------------------------------KSLM--------------  456
Kv10.1    ---------------------------------PMKR---KNEAPLILPPDH------  735
Kv10.2    ---------------------------------RLRQ---KNEVTLSIPVDH------  704
Kv11.1    ---------------------------------QRK----RKLS---FRRRT------  895
Kv11.2    ---------------------------------QAP----GSQD--HQGFFL------  739
Kv11.3    ---------------------------------LRR----RKLSFESEGEKE------  904
Kv12.1    ---------------------------------KSM----VSQSEPKGNGNI------  702
Kv12.2    ---------------------------------DNT---LMSTLEEKETDGE------  736
Kv12.3    ---------------------------------SPRLSQPRSESLGSSSDKTLPSIT   726
HCN1      ----------------------------------SNLHS---PSPSTQTPQPSAILS--  695
HCN2      ----------------------------------GPLAL---GSPRLV--RRPFP---  763
HCN3      ----------------------------------GAQLS---GKPVLWEPLVH------  608
HCN4      ----------------------------------GSASPA---SSPSQVDTPSSSSFHIQ 860
CatSper1  ----------------------------------LRALRAIRVLRPLSFLTSVQE---  571
CatSper2  ----------------------------------------KKLQEF------------  517
CatSper3  ----------------------------------------HVLSLMLEDLPQE-----  387
CatSper4  ----------------------------------------SKDIRQMSQQQDLL----  447
Hv1       ----------------------------------------------------------
KCa1.1    ---------------------------------------GMLRQPSITTGVNIPII   948
KCa4.1    RE-------------------------------NGSNLAFMFRLPFAAGRV---FS   971
KCa4.2    RE-------------------------------RGSNLAFMFRLPFAAGRV---FS   889
TPC1      ----------------------------------------DVTRLLETLSQME----  820
```

Figure 15BC

```
Shaker   QH---------------------VTQTQLYQQQQQQQQQQNGFKQQQQQTQQQLQQ 618
Nav1.1   AKGIRTLLFALMMSLPALFNIGLLLFLVMFIYAIFGMSNF---------------- 1692
Nav1.2   AKGIRTLLFALMMSLPALFNIGLLLFLVMFIYAIFGMSNF---------------- 1682
Nav1.3   AKGIRTLLFALMMSLPALFNIGLLLFLVMFIYAIFGMSNF---------------- 1677
Nav1.4   AKGIRTLLFALMMSLPALFNIGLLLFLVMFIYSIFGMSNF---------------- 1504
Nav1.5   AKGIRTLLFALMMSLPALFNIGLLLFLVMFIYSIFGMANF---------------- 1679
Nav1.6   AKGIRTLLFALMMSLPALFNIGLLLFLVMFIFSIFGMSNF---------------- 1673
Nav1.7   AKGIRTLLFALMMSLPALFNIGLLLFLVMFIYAIFGMSNF---------------- 1655
Nav1.8   AKGIRTLLFALMMSLPALFNIGLLLFLVMFIYSIFGMSSF---------------- 1629
Nav1.9   ARGIRTLLFALMMSLPSLFNIGLLLFLIMFIYAILGMNWF---------------- 1519
Cav1.1   WAE---------------------YDPEAKGRIKHLDVVTLLRRIQPPLGFGKF 1438
Cav1.2   WAE---------------------YDPEAKGRIKHLDVVTLLRRIQPPLGFGKL 1493
Cav1.3   WSE---------------------YDPEAKGRIKHLDVVTLLRRIQPPLGFGKL 1521
Cav1.4   WSE---------------------YDPGAKGRIKHLDVVALLRRIQPPLGFGKL 1487
Cav2.1   WAE---------------------YDPAAWGRMPYLDMYQMLRHMSPPLGLGKK 1873
Cav2.2   WAE---------------------YDPAACGRISYNDMFEMLKHMSPPLGLGKK 1765
Cav2.3   WAE---------------------YDRAACGRIHYTEMYEMLTLMSPPLGLGKR 1761
Cav3.1   TVMQALPQVGNLGLLFMLLFFIFAALGVELFGDLECDETHPCEGLGRHATFRNFGMAFLT 1794
Cav3.2   TVVQALPQVGNLGLLFMLLFFIYAALGVELFGRLECSEDNPCEGLSRHATFSNFGMAFLT 1800
Cav3.3   TVVQALPQVGNLGLLFMLLFFIYAALGVELFGKLVCNDENPCEGMSRHATFENFGMAFLT 1635
Kv1.1    ------------------------------------------------------------
Kv1.2    ------------------------------------------------------------
Kv1.3    ------------------------------------------------------------
Kv1.4    ------------------------------------------------------------
Kv1.5    ------------------------------------------------------------
Kv1.6    ------------------------------------------------------------
Kv1.7    ------------------------------------------------------------
Kv1.8    ------------------------------------------------------------
Kv2.1    FPEATRF--------SHSPLTSLPSKTGGSTAPEVGWRG---------ALGASGG--- 635
Kv2.2    FTETERSPLPPP----SASHLQMKFPTDLPGTEEHQRARGPPFLTLSREKGPAARDGTFLE 668
Kv3.1    ------------------------------------------------------------
Kv3.2    PI---------------------------------------------------- 560
Kv3.3    MGLPPLPAPGEPCPLAQEEVIEINRADPRPNGDPAAAALAHEDCPAIDQPAMSPEDKSPI 693
Kv3.4    EG--------------AGLTQPLASSPTPEERRALPRSTT------------------ 579
Kv4.1    ----------------------RTSR---------------STS--- 517
Kv4.2    ----------------------ATVN---------------RPS--- 513
Kv4.3    TIKNHEF----------------IDEQMFEQNCMESS---------------MQN--- 527
Kv5.1    ------------------------------------------------------------
Kv6.1    ------------------------------------------------------------
Kv6.2    ------------------------------------------------------------
Kv6.3    ------------------------------------------------------------
Kv6.4    ------------------------------------------------------------
Kv7.1    ------------------------------------------------------------
Kv7.2    VQ---------------------CPPSTSWQPQSHP------------- 724
Kv7.3    PP---------------------YSFHQVTIDKVSPYGFFA-------- 714
Kv7.4    ------------------------------------------------------------
Kv7.5    NTAPKPAAPTTLQIPPPL-----------PAIKHLPRPETLHPNPAGLQES-------- 776
Kv8.1    ------------------------------------------------------------
Kv8.2    ------------------------------------------------------------
Kv9.1    ------------------------------------------------------------
Kv9.2    ------------------------------------------------------------
Kv9.3    ------------------------------------------------------------
Kv10.1   --------------------PVRPLFQRFRQQ---------------KEAR 751
Kv10.2   --------------------PVRKLFQKFKQQ---------------KELR 720
Kv11.1   --------------------DKDTEQPGEV-----------------SALG 909
Kv11.2   --------------------SDNQS--GSP-----------------HELG 751
Kv11.3   --------------------NSTNDPEDSA-----------------DTIR 918
Kv12.1   --------------------NKRLPSIVEDEEEEEEGEEEEA-----VSLS 728
Kv12.2   --------------------QGPTVSPAPA-----------------DEFS 750
Kv12.3   EAE------------------SGAEPGGGPRP---------------RRPL 744
HCN1     --------------------PCSYTTAVCSPPVQS------------- 710
HCN2     --------------------GPAPAAASPGPP---------------- 775
```

Figure 15BD

```
HCN3        ---------------------------------APLQAAAVTS------------------- 618
HCN4        QL-------------------------------AGFSAPAGLSPLLPSSSSSPPPGACGSPSA 892
CatSper1    ---------------------------------VTGTLGQSLPSIAAILILMFTCL 594
CatSper2    ------------------------------------------------------------
CatSper3    ------------------------------------------------------------
CatSper4    ------------------------------------------------------------
Hv1         ------------------------------------------------------------
KCa1.1      TEL--------------------------------------------------------- 951
KCa4.1      ISMLDTLLYQSFV------------------KDYMITITRLLLGLDTTP-----GSGYLC 1008
KCa4.2      ISMLDTLLYQSFV------------------KDYMISITRLLLGLDTTP-----GSGFLC 926
TPC1        ------------------------------------------------------------

Shaker      QQSHTINA---SAAAATSGSGSSG-----------------------------LTMRH-NN 646
Nav1.1      -AYVKREV---GIDDMFNFETFGNSMICLFQ----------------------ITTSAGWD 1727
Nav1.2      -AYVKREV---GIDDMFNFETFGNSMICLFQ----------------------ITTSAGWD 1717
Nav1.3      -AYVKREA---GIDDMFNFETFGNSMICLFQ----------------------ITTSAGWD 1712
Nav1.4      -AYVKRES---GIDDMFNFETFGNSIICLFE----------------------ITTSAGWD 1539
Nav1.5      -AYVKWEA---GIDDMFNFQTFANSMLCLFQ----------------------ITTSAGWD 1714
Nav1.6      -AYVKREA---GIDDMFNFETFGNSMICLFQ----------------------ITTSAGWD 1708
Nav1.7      -AYVKKED---GINDMFNFETFGNSMICLFQ----------------------ITTSAGWD 1690
Nav1.8      -PHVRWEA---GIDDMFNFQTFANSMLCLFQ----------------------ITTSAGWD 1664
Nav1.9      -SKVNPES---GIDDIFNFKTFASSMLCLFQ----------------------ISTSAGWD 1554
Cav1.1      CPHRVACK---RLVGMRNMP-LNSDGTVTFNATLFALV----------RTALKIKTEGNF 1483
Cav1.2      CPHRVACK---RLVSMRNMP-LNSDGTVMFNATLFALV----------RTALRIKTEGNL 1538
Cav1.3      CPHRVACK---RLVAMNMP-LNSDGTVMFNATLFALV----------RTALKIKTEGNL 1566
Cav1.4      CPHRVACK---RLVAMNMP-LNSDGTVTFNATLFALV----------RTSLKIKTEGNL 1532
Cav2.1      CPARVAYK---RLLRMDLP-VADDNTVHFNSTLMALI----------RTALDIKIAKGG 1918
Cav2.2      CPARVAYK---RLVRMRNMPISNEDMTVHFTSTLMALI----------RTALEIKLAPAG 1811
Cav2.3      CPSKVAYK---RLVLMRNMP-VAEDMTVHFTSTLMALI----------RTALDIKIAKGG 1806
Cav3.1      LFRVSTGD---NWNGIMKDTLRDCDQESTCYNTVI---SPIYFVSFVLTAQFVLNVVIA 1848
Cav3.2      LFRVSTGD---NWNGIMKDTLRECSREDKHCLSYLPALSPVYFVTFVLAQFVLNVVVA 1857
Cav3.3      LFQVSTGD---NWNGIMKDTLRDCTHDERSCLSSLQFVSPLYFVSFVLTAQFVLINVVVA 1692
Kv1.1       ---HYRQV---NIRTANCTTANQ-------------------------NCVNKSK 490
Kv1.2       ---DFREE---NLKTANCTLANT-------------------------NYVNITK 494
Kv1.3       ---TPFKT---GNSTATCTTNNNP------------------------NSCVNIKK 570
Kv1.4       ---KEEKC---QGKGDDSETDKN-------------------------NCSNAKA 648
Kv1.5       ---CPLEK---CNVKAKS-----------------------------NVDLRR 598
Kv1.6       ---DFPEA---NRERRPSYLPTP------------------------HRAYAEKR 524
Kv1.7       ---VPELP---PPLWAPP----------------------------GKHLV- 453
Kv1.8       -----------LNKTNGG----------------------------CSTEKS 509
Kv2.1       -RFVEANP---SPDASQH-SSFFIES---------------------PKSSMKTN 664
Kv2.2       YAPVDITV---NLDASGSQCGLHSPL---------------------QSDNATDS 699
Kv3.1       ---RAGRK---PLRGMSI-------------------------------- 511
Kv3.2       ---RRSST---RDKNRRGETCFLL-----------------------TTGDYTCA 586
Kv3.3       TPGSRGRY---SRDRACFLL----------------------------TDYAPSP 717
Kv3.4       ---RDPNK---KAAACFLLS----------------------------TGDYACA 600
Kv4.1       ---VSSQP---V-GPGSLLSSC-------------------------CPRRAKRR 540
Kv4.2       ----S---H---SPSLSSQQGVTST---------------------CCSRRHKK 536
Kv4.3       ---YPSTR---SPSLSSHPGLTTT----------------------CCSRRSKK 553
Kv5.1       ---CSSRL---KLSHSDTFIPLLTEE---------------------KHHRTR 489
Kv6.1       ---DILFG---SASSDTR-----------------------------DNN--- 513
Kv6.2       ---AGLAD---DSADALW-----------------------------VRAGR- 466
Kv6.3       ------------------------------------------------------
Kv6.4       ---ASEHE---LMNDVNDLILEGPAL---------------------PIMHM--- 519
Kv7.1       ---VSEKS---KDRGSNTIGARLNRVE--------------------DKVTQL 602
Kv7.2       ----RQGH---GTSPVGDHGSLVRIPPPA-------------------HERSLS--- 753
Kv7.3       ---HDPVN---LPRGGPSSGKVQATPPSSA------------------TTYVERPTV 747
Kv7.4       -----TRV---DQIVGRGPGDRKA-----------------------REK---- 599
Kv7.5       ---ISDVT----TCLVASKENVQVAQS--------------------NLTKDR--- 802
Kv8.1       ---ASTRS---SGGDDFWF-----------------------------500
Kv8.2       ------------------------------------------------------
Kv9.1       -----RETS----QEGQSADLE--------------------------SQAPSE 519
Kv9.2       -----ASLTN----MSRSSPSEL-------------------------SLNDSL 476
```

Figure 15BE

```
Kv9.3        ---ASLTN---MSRSSPSEL------------------------------SLDDSL 476
Kv10.1       LAAERGGR---DLDDLDVE-------------------------------KGNVLTE 774
Kv10.2       ----NQGS---TQGDPERNQLQVESRSLQ---------------------NGASITG 749
Kv11.1       P--GRAGA---GPSSRGRPGGPWGESP-----------------------SSGPSSPE 939
Kv11.2       PQFPSKGY---SLLGPGSQNS-----------------------------MGAGP-- 774
Kv11.3       HYQSSKRH---FEEKKSRSSSFI---------------------------SSIDDEQ 945
Kv12.1       PICTRGSS---SRNKKVGSNKAYLGLSLKQL-------------------ASGTVPFH 764
Kv12.2       SPLLSPGC---TSSSSAAKLLSP---------------------------RRTAPRP 777
Kv12.3       LLPNLSPA---RPRGSLVSLLGEELPPFSAL-------------------VSSPSL-- 778
HCN1         ---PLAAR---TFHYASPTASQLSLMQQQPQQQVQQSQPPQTQPQQPSPQPQTPGSSTPK 764
HCN2         ---PPASP---PGAPAS-----PR--------------------------APRT-- 792
HCN3         ---NVAIA---LTHQRGPLPLSPD--------------------------SPATLL 642
HCN4         PTPSAGVA---ATTIAG-----PG--------------------------HFHKAL 914
CatSper1     FLFSAVLR---ALFRKSDPKRFQNIFFTIFTLF-----------------TLLTLDDWSLI 635
CatSper2     ---AVQAL---MNLEDK-----------------------------------  528
CatSper3     ----KPQS---LEKVDEK----------------------------------  398
CatSper4     ---SALVS---MEKVHDSSSQILL-------------------------KKHKSS 471
Hv1          ------------------------------------------------------
KCa1.1       --VNDTNVQFLDQDDDDDPDTELYLTQPFACGTAF---------------AVSVLDS 991
KCa4.1       ---AMKIT---EGDLWIRTYGRLFQKLCSSS-------------------AEIPI 1038
KCa4.2       ---SMKIT---ADDLWIRTYARLYQKLCSST-------------------GDVPI 956
TPC1         ---RYQQHSMVFLGRRSRTKSDLSL-------------------------KMYQEE 848

Shaker       ALAVSIETDV------------------------------------------ 656
Nav1.1       GLLAPILNSKPPDCDPNKVNP--------GSSVKGDCGNPSVGIFFFVSYIIISFLVVVN 1779
Nav1.2       GLLAPILNSGPPDCDPDKDHP--------GSSVKGDCGNPSVGIFFFVSYIIISFLVVVN 1769
Nav1.3       GLLAPILNSAPPDCDPDTIHP--------GSSVKGDCGNPSVGIFFFVSYIIISFLVVVN 1764
Nav1.4       GLLNPILNSGPPDCDPNLENP--------GTSVKGDCGNPSIGICFFCSYIIISFLIVVN 1591
Nav1.5       GLLSPILNTGPPYCDPTLPN---------SNGSRGDCGSPAVGILFFTTYIIISFLIVVN 1765
Nav1.6       GLLLPILNRPP-DCSLDKEHP--------GSGFKGDCGNPSVGIFFFVSYIIISFLIVVN 1759
Nav1.7       GLLAPILNSKPPDCDPKKVHP--------GSSVEGDCGNPSVGIPYFVSYIIISFLVVVN 1742
Nav1.8       GLLSPILNTGPPYCDPNLPN---------SNGTRGDCGSPAVGILFFTTYIIISFLIMVN 1715
Nav1.9       SLLSPMLRSKE-SCNSSSEN---------CHLPGIATSYFVS-------YIIISFLIVVN 1597
Cav1.1       EQANEELRAIIKKI--WKRTSMKLLDQV--IPPIGDDEVTVGKFYATFLIQEHFRKFMKR 1539
Cav1.2       EQANEELRAIIKKI--WKRTSMKLLDQV--VPPAGDDEVTVGKFYATFLIQEHFRKFKKR 1594
Cav1.3       EQANEELRAVIKKI--WKKTSMKLLDQV--VPPAGDDEVTVGKFYATFLIQDYFRKFKKR 1622
Cav1.4       EQANQELRIVIKKI--WKRMKQKLLDEV--IPPPDEEEVTVGKFYATFLIQDYFRKFRRR 1588
Cav2.1       A-DKQQMDAELRKEMMAIWPNLSQKTLDLLVTPHKSTDLTVGKIYAA----MMIMEYYRQ 1973
Cav2.2       T-KQHQCDAELRKEISVVWANLPQKTLDLLVPPHKPDEMTVGKVYAA----LMIFDFYKQ 1866
Cav2.3       A-DRQQLDSELQKETLAIWPHLSQKMLDLLVPMPKASDLTVGKIYAA----MMIMDYYKQ 1861
Cav3.1       VLMKHLEESNKEAKEEAELEAELELEM-KTLSPQPHSPLGS------PFLWPGVEGPDSP 1901
Cav3.2       VLMKHLEESNKEAREDAELDAEIELEMAQGPGSARRVDADRPPLPQESPGARDAPNLVAR 1917
Cav3.3       VLMKHLDDSNKEAQEDAEMDAELELEMAHGLGP-GPRLPTG------SPGAPGR-GPGGA 1744
Kv1.1        LL-----TDV------------------------------------------ 495
Kv1.2        ML-----TDV------------------------------------------ 499
Kv1.3        IF-----TDV------------------------------------------ 575
Kv1.4        VE-----TDV------------------------------------------ 653
Kv1.5        SLYALCLDTSRETDL-------------------------------------- 613
Kv1.6        ML-----TEV------------------------------------------ 529
Kv1.7        -------TEV------------------------------------------ 456
Kv1.8        RK--------------------------------------------------- 511
Kv2.1        --NPLKLRALKVNFMEGDPSP--------LLPVLGMYHDPLRN--------RGSAAAAVA 706
Kv2.2        PKSSLKGSNPLKSRSLKV-NF--------KENRGSAPQTPPST--------ARPLPVTTA 742
Kv3.1        -----------------------------------------------------
Kv3.2        SDGGIPKDNC------KEVVI--------TGYTQAEARSLT------------ 613
Kv3.3        DGSIRKATGAPPLPPQDWRKP--------GPPSFLPDLNANAA--------AWISP---- 757
Kv3.4        DGSVRKGTP-------VLRDL--------PLQHSPEAACPPTA--------GTLFLPH-- 635
Kv4.1        AIPLANSTA--SVSGSM-----------QELDMLAGLRRS-------HAP---QSR 574
Kv4.2        TFRIPNANV--SGSHQGS-----------IQELSTIQIRCV---------ERTPLSNSR 573
Kv4.3        TTHLPNSNL--PATRLRS-----------MQELSTIHIQGS---------EQPSLTTSR 590
Kv5.1        LQSCK------------------------------------------------ 494
```

Figure 15BF

```
Kv6.1       ------------------------------------------------------------
Kv6.2       ------------------------------------------------------------
Kv6.3       ------------------------------------------------------------
Kv6.4       ------------------------------------------------------------
Kv7.1       DQRLALITDMLHQLL---------------------SLHGGSTPGSGGPP-----------REGGA 636
Kv7.2       -------AYGG-------------------------GNRASMEFLR-------QEDTPGCR 775
Kv7.3       LPILTLLDSRV-------------------------SCHSQADLQG-------PYSDRISP 776
Kv7.4       --------GDKG------------------------PSDAEV--------------VDEISM 615
Kv7.5       --------SMRK------------------------SFDMGG--------------ETLLSV 818
Kv8.1       ------------------------------------------------------------
Kv8.2       ------------------------------------------------------------
Kv9.1       PPHPQMY------------------------------------------------------ 526
Kv9.2       R------------------------------------------------------------ 477
Kv9.3       H------------------------------------------------------------ 477
Kv10.1      H------ASAN-------------------------HSLVK------------------ASV 787
Kv10.2      T------SVVT-------------------------VSQITPIQT-------------SLAYV 768
Kv11.1      S----SEDEGP-------------------------GRSSSPL----------------RLVPF 958
Kv11.2      --------CAP-------------------------GHPDAAPPL-------------SISDA 791
Kv11.3      K----PLFSGI-------------------------VDSSP----------------GIGKA 962
Kv12.1      SP---IRVSRS-------------------------NSPKTKQEI------------DPPNH 786
Kv12.2      RL---GGRGRP-------------------------GRAGALKAE------------AGPSA 799
Kv12.3      SP---SLSPAL-------------------------AGQGHSASP-----------HGPPR 800
HCN1        N------EVHK-------------------------STQALHNTNL-------T----REV 783
HCN2        --------SPY-------------------------GGLP-AAPL-----------AGPA 807
HCN3        A------RSAW-------------------------RS---AG--------------SPA 654
HCN4        G------GSLS-------------------------SS---DSPLL-------TPLQPGAR 934
CatSper1    YMDSRAQGAWYIIPILIIYIIIQYFIFLNLVITVLVDSFQTALFK-----------GLEKA 685
CatSper2    ------------------------------------------------------------
CatSper3    ------------------------------------------------------------
CatSper4    H------------------------------------------------------------ 472
Hv1         ------------------------------------------------------------
KCa1.1      LMSATYFNDNILTLIRTLVTGGATPELEALIAEENALRGGYSTPQ---------TLANRD 1042
KCa4.1      GIYRTESHVFS-------------------------TSEPHD----------LRAQSQISV 1064
KCa4.2      GIYRTESQRLT-------------------------TSE-------------SQISI 975
TPC1        IQEWYEEHAREQEQQ---------------RQLSSSAAPAAQQPP--------GSRQR 883

Shaker      ------------------------------------------------------------
Nav1.1      MYIAVILENFSVATEESAEPLSEDDFEMFYEVWEKFDPDATQFMEFEKLSQFAAALEPPL 1839
Nav1.2      MYIAVILENFSVATEESAEPLSEDDFEMFYEVWEKFDPDATQFIEFAKLSDFADALDPPL 1829
Nav1.3      MYIAVILENFSVATEESAEPLSEDDFEMFYEVWEKFDPDATQFIEFSKLSDFAAALDPPL 1824
Nav1.4      MYIAIILENFNVATEESSEPLGEDDFEMFYETWEKFDPDATQFIAYSRLSDFVDTLQEPL 1651
Nav1.5      MYIAIILENFSVATEESTEPLSEDDFDMFYEIWEKFDPEATQFIEYSVLSDFADALSEPL 1825
Nav1.6      MYIAIILENFSVATEESADPLSEDDFETFYEIWEKFDPDATQFIEYCKLADFADALEHPL 1819
Nav1.7      MYIAVILENFSVATEESTEPLSEDDFEMFYEVWEKFDPDATQFIEFSKLSDFAAALDPPL 1802
Nav1.8      MYIAVILENFNVATEESTEPLSEDDFDMFYETWEKFDPEATQFITFSALSDFADTLSGPL 1775
Nav1.9      MYIAVILENFNTATEESEDPLGEDDFDIFYEVWEKFDPEATQFIKYSALSDFADALPEPL 1657
Cav1.1      QEEY-YGY------------------------RPKKDI---------------- 1552
Cav1.2      KEQGLVGKPSQRNALSLQ--AGLRTLHDIGPEIPRAISGDL-TAEEELDKAMKEAVSAAS 1651
Cav1.3      KEQGLVGK-YPAKNTTIALQAGLRTLHDIGPEIPRAISCDLQDDEPEETKREEEDDVF-- 1679
Cav1.4      KEKGLLGN---------------------DAAPSTS------------------ 1603
Cav2.1      S--KAKKLQAMREEQD---------------------RTPL------------------ 1991
Cav2.2      N--KTTRDQMQQAPGGLSQ---------------MGPVSLF------------------ 1890
Cav2.3      S--KVKKQ-------RQQL---------------EEQKNAP------------------ 1878
Cav3.1      DSPKP------GALHPAAHARSASHFS------LEHPTDRQLF-----DTISLLIQGSLE 1944
Cav3.2      KVSVSPMLSLPNDSYMFRPVVPASAPHPRPLQEVEMETYGA-------GTPL----GSVA 1966
Cav3.3      GGGGDTEGGLCRRCYSPAQENLWLDSV------SLIIKDSLEGELTIIDNLS----GSIF 1794
Kv1.1       ------------------------------------------------------------
Kv1.2       ------------------------------------------------------------
Kv1.3       ------------------------------------------------------------
Kv1.4       ------------------------------------------------------------
Kv1.5       ------------------------------------------------------------
Kv1.6       ------------------------------------------------------------
Kv1.7       ------------------------------------------------------------
```

Figure 15BG

```
Kv1.8     -----------------------------------------------------------
Kv2.1     GLECATLLD--------KAVLSPESSIYTTASA-----KTPPR-SPEKHTAIAFNFEAGV  752
Kv2.2     DFSLTTPQHISTILLEETPSQGDRPLLGTEVSAPCQGPSKGLSPRFPKQKLFPFSSRERR  802
Kv3.1     -----------------------------------------------------------
Kv3.2     -----------------------------------------------------------
Kv3.3     -----------------------------------------------------------
Kv3.4     -----------------------------------------------------------
Kv4.1     S-----------------------SLNAKP-----------------------------  581
Kv4.2     S-----------------------SLNAKM-----------------------------  580
Kv4.3     S-----------------------SLNLKA-----------------------------  597
Kv5.1     -----------------------------------------------------------
Kv6.1     -----------------------------------------------------------
Kv6.2     -----------------------------------------------------------
Kv6.3     -----------------------------------------------------------
Kv6.4     -----------------------------------------------------------
Kv7.1     HITQPC--------------------------------------------------      642
Kv7.2     PPEGNL--------------------------RDSDTSI--------------------  788
Kv7.3     RQRRSIT-------------------------RDSDTPL--------------------  790
Kv7.4     MGRVV---------------------------KVEKQVQ--------------------  627
Kv7.5     CPMVP---------------------------KDLGKSL--------------------  830
Kv8.1     -----------------------------------------------------------
Kv8.2     -----------------------------------------------------------
Kv9.1     -----------------------------------------------------------
Kv9.2     -----------------------------------------------------------
Kv9.3     -----------------------------------------------------------
Kv10.1    V-------------------------------TV-------------------------  790
Kv10.2    K-------------------------------TSESL----------------------  774
Kv11.1    SSPRPPGEPP----------------------GGEPLMEDCEKS---------------  980
Kv11.2    SGLWPELLQE----------------------MPPRHSPQSPQE---------------  813
Kv11.3    SGLDPEE-------------------------TVPTS----------------------  974
Kv12.1    NKRKEKNLKL----------------------QLSTLNNAGPP---------------   807
Kv12.2    PPRALEGLRL----------------------PPMP--WNVPP---------------   818
Kv12.3    CSAAWKPPQL----------------------LIPPLGTFGPP---------------   821
HCN1      RPLSASQPSL----------------------PHEVSTLI-----------------   801
HCN2      LPARRL--------------------------SRASRPL------------------   820
HCN3      SPLVP---------------------------VRAGF--------------------   664
HCN4      SPQAAQPSPA----------------------PPGARGGLGLPEHFLPPPPSSRSPSSSPG  973
CatSper1  KQERAARIQE-------------------------------------------------   695
CatSper2  -----------------------------------------------------------
CatSper3  -----------------------------------------------------------
CatSper4  -----------------------------------------------------------
Hv1       -----------------------------------------------------------
KCa1.1    RCRVAQLALLDGPFADLGDGGCYGDLFCKALKTYNMLCFGI------------------ 1083
KCa4.1    NVED-------------------------------CEDTRE------------------ 1074
KCa4.2    SVEE-------------------------------WEDTK-------------------  984
TPC1      SQTVT-------------------------------------------------------  888

Shaker    -----------------------------------------------------------
Nav1.1    NLPQPNKLQLIAMDLPMVSGDRIHCLDILFAFTKRVLGESGEMD-----------ALRI 1887
Nav1.2    LIAKPNKVQLIAMDLPMVSGDRIHCLDILFAFTKRVLGESGEMD-----------ALRI 1877
Nav1.3    LIAKPNKVQLIAMDLPMVSGDRIHCLDILFAFTKRVLGESGEMD-----------ALRI 1872
Nav1.4    RIAKPNKIKLITLDLPMVPGDKIHCLDILFALTKEVLGDSGEMD-----------ALKQ 1699
Nav1.5    RIAKPNQISLINMDLPMVSGDRIHCMDILFAFTKRVLGESGEMD-----------ALKI 1873
Nav1.6    RVPKPNTIELIAMDLPMVSGDRIHCLDILFAFTKRVLGDSGELD-----------ILRQ 1867
Nav1.7    LIAKPNKVQLIAMDLPMVSGDRIHCLDILFAFTKRVLGESGEMD-----------SLRS 1850
Nav1.8    RIPKPNRNILIQMDLPLVPGDKIHCLDILFAFTKNVLGESGELD-----------SLKA 1823
Nav1.9    RVAKPNKYQFLVMDLPMVSEDRLHCMDILFAFTARVLGGSDGLD-----------SMKA 1705
Cav1.1    ----------VQIQAGLRTIEEEAAPEI------------------------------- 1570
Cav1.2    EDDIFRRAGGLFGNHVSYYQSDGRSAFPQTFTTQRPLHINK------AGSSQG-------DT 1700
Cav1.3    -----KRNGALLGNHVNHVNSDRRDSLQQTNTTHRPLHVQRPSIPPASDTEKPLFPPAGN 1734
Cav1.4    ---------SALQAGLRSLQDLGFEMRQALTCDTEEEEEEGQE----GVEEEDE-----KD 1646
Cav2.1    -----MFQRMEPPSPTQEGGPGQNALP------STQLDPGGALM-----------AHE 2027
```

Figure 15BH

```
Cav2.2       -----HPLKATLEQ-TQPAVLRGARVFLPQKSSTSLSNGGAIQ---------------NQE  1930
Cav2.3       -----MFQRMEPSSLPQEIIANAKALP------YLQQDPVSGL-----------------  1910
Cav3.1       WEL----------KLMDELAGPGGQPSAFPSAPSLGGSDPQIPL-------------AEME  1982
Cav3.2       ---------------SVHSPPAESCASLQIPLAVSSPARSG------------------EPLH  1996
Cav3.3       -------------HHYSSPAGCKKC-----HHDKQEVQL------------------AETE  1819
Kv1.1        ------------------------------------------------------------
Kv1.2        ------------------------------------------------------------
Kv1.3        ------------------------------------------------------------
Kv1.4        ------------------------------------------------------------
Kv1.5        ------------------------------------------------------------
Kv1.6        ------------------------------------------------------------
Kv1.7        ------------------------------------------------------------
Kv1.8        ------------------------------------------------------------
Kv2.1        HQYIDADTDDEGQLLYSVDSSPPKSLPGSTSPKFSTGTRSEKNH------------FESS  800
Kv2.2        SFTEIDTGDDEDPLELPGAREEKQVDSSPNCFADKPSDGRDPLR------------EEGS  850
Kv3.1        ------------------------------------------------------------
Kv3.2        ------------------------------------------------------------
Kv3.3        ------------------------------------------------------------
Kv3.4        ------------------------------------------------------------
Kv4.1        ------------------------HDSLDLNCDSRDFVAA--------------IISI  601
Kv4.2        ------------------------EECVKLNCEQPYVTTA--------------IISI  600
Kv4.3        ------------------------DDGLRPNCKTSQITTA--------------IISI  617
Kv5.1        ------------------------------------------------------------
Kv6.1        ------------------------------------------------------------
Kv6.2        ------------------------------------------------------------
Kv6.3        ------------------------------------------------------------
Kv6.4        ------------------------------------------------------------
Kv7.1        --------------------------GSGGSVDPELFLP---------------  655
Kv7.2        --------------------------SIPSVD----------------------  794
Kv7.3        --------------------------SLMSVN----------------------  796
Kv7.4        --------------------------SIEHKL----------------------  633
Kv7.5        --------------------------SVQNLI----------------------  836
Kv8.1        ------------------------------------------------------------
Kv8.2        ------------------------------------------------------------
Kv9.1        ------------------------------------------------------------
Kv9.2        ------------------------------------------------------------
Kv9.3        ------------------------------------------------------------
Kv10.1       --------------------------RESPATP---------------------  797
Kv10.2       --------------------------KQNNRDA---------------------  781
Kv11.1       --------------------------SDTCNPL---------------------  987
Kv11.2       --------------------------DPDCWP----------------------  819
Kv11.3       --------------------------GRMHI-----------------------  979
Kv12.1       --------------------------DLSPRIV---------------------  814
Kv12.2       --------------------------DLSPRVV---------------------  825
Kv12.3       --------------------------DLSPRIV---------------------  828
HCN1         --------------------------SRPHPT----------------------  807
HCN2         --------------------------SASQPS----------------------  826
HCN3         --------------------------WASTSR----------------------  670
HCN4         QLGQPPGELSLGLATGPLSTPETPPRQPEPPSLVAGASG-----------------  1012
CatSper1     ------------------------------------------------------------
CatSper2     ------------------------------------------------------------
CatSper3     ------------------------------------------------------------
CatSper4     ------------------------------------------------------------
Hv1          ------------------------------------------------------------
KCa1.1       --------------------------YRLRDAHLSTP-----------------  1094
KCa4.1       --------------------------VKGPWGSR--------------------  1082
KCa4.2       --------------------------DSKEQGHH--------------------  992
TPC1         ------------------------------------------------------------
```

Figure 15BI

```
Shaker   --------------------------------------------------------------
Nav1.1   QMEERFMASNPSKVSYQPITTTLKRKQEEVSAVIIQRAYRRHLLKRTVKQASFTYNKNKI 1947
Nav1.2   QMEERFMASNPSKVSYEPITTTLKRKQEEVSAIIIQRAYRRYLLKQKVKKVSSIYKKDKG 1937
Nav1.3   QMEDRFMASNPSKVSYEPITTTLKRKQEEVSAAIIQRNFRCYLLKQRLKNISSNYNKEAI 1932
Nav1.4   TMEEKFMAANPSKVSYEPITTTLKRKHEEVCAIKIQRAYRRHLLQRSMKQASYMYRHSHD 1759
Nav1.5   QMEEKFMAANPSKISYEPITTTLRPKHEEVSAMVIQRAFRRHLLQRSLKHASFLFRQQAG 1933
Nav1.6   QMEERFVASNPSKVSYEPITTTLRPKQEEVSAVVLQRAYRGH---LARRGFICKKTTSNK 1924
Nav1.7   QMEERFMSANPSKVSYEPITTTLKRKQEDVSATVIQRAYRRYRLRQNVKNISSIYIKDG- 1909
Nav1.8   NMEEKFMATNLSKSSYEPIATTLRWKQEDISATVIQKAYRSY---VLHRSMALSNTPCVP 1880
Nav1.9   MMEEKFMEANPLKKLYEPIVTTTKRKEEERGAAIIQKAFRKY---------MMKVTKGDQ 1756
Cav1.1   CRTVSGDLAAEEELE-------------------RAMVEAAMEEGIFRRTGGLFGQ--- 1607
Cav1.2   ESPSHEKLVDSTFTPSSYSST--------------GSNANINNANNTALGRLPRPAG---- 1743
Cav1.3   SVCHNHHNHNSIGKQVPTSTNANL----------NNANMSKAAHGKRPSIGNLEHV---- 1780
Cav1.4   LETNKATMVSQP-----------------------SARRGSGISVSLPVGDRLPDSL--- 1680
Cav2.1   SGLKESPSWVTQR-------------------------AQEMFQKTGTW-SPEQGPPTD--- 2060
Cav2.2   SGIKESVSWGTQRTQDAPHEARPPLERGHSTEIPVGRSGALAVDVQMQSITRRGPDGEPQ 1990
Cav2.3   SGRSGYPSMSPLSPQDIFQL------------------ACMDPADDGQFQERQSLVVTD--- 1951
Cav3.1   ALSLTSEIVS-----EPSCSLALTDDSLPDDMHTLLLSALESNMQPHPTELPGPDLLTVR 2037
Cav3.2   ALSPRGTARSPSLSRLLCRQEAVHTDSLEGKIDSP--RDTLDPAEPGEKTPVRPV--TQG 2052
Cav3.3   AFSLNSDRSS--------SILLGDDLSLEDPTACPP-GRKDSKGELDPPEPMRVG--DLG 1868
Kv1.1    --------------------------------------------------------------
Kv1.2    --------------------------------------------------------------
Kv1.3    --------------------------------------------------------------
Kv1.4    --------------------------------------------------------------
Kv1.5    --------------------------------------------------------------
Kv1.6    --------------------------------------------------------------
Kv1.7    --------------------------------------------------------------
Kv1.8    --------------------------------------------------------------
Kv2.1    PLPTSPKFLRQNCIYSTEALTGKGPSGQEKCKLENHISPDV------PVLPGGGAHGS-- 852
Kv2.2    VG--SSSPQDTGHNCRQDIYHAVSEVKK-DSSQEGCKMENHLFAPEIHS--NPGDTGYCP 905
Kv3.1    --------------------------------------------------------------
Kv3.2    --------------------------------------------------------------
Kv3.3    --------------------------------------------------------------
Kv3.4    --------------------------------------------------------------
Kv4.1    PTPPANTP-DESQPS---------SPGGGGRAG---STLRNSSLGTPCLFPETVKISSL-- 647
Kv4.2    PTPPVTTPEGDDRPE---------SPEYSGGNI---VRVSAL------------------ 630
Kv4.3    PTPPALTPEGESRPPPASPGPNTNIPSIASNV---VKVSAL------------------ 655
Kv5.1    --------------------------------------------------------------
Kv6.1    --------------------------------------------------------------
Kv6.2    --------------------------------------------------------------
Kv6.3    --------------------------------------------------------------
Kv6.4    --------------------------------------------------------------
Kv7.1    -----SNTLPT-----------------YEQLTVPRRGPDEGS----------- 676
Kv7.2    -----HEELER-----------------SFS------GFSIS------------ 808
Kv7.3    -----HEELER-----------------SPS------GFSIS------------ 810
Kv7.4    -----DLLLGF-----------------Y--------SRCLR------------ 645
Kv7.5    -----RSTEEL-----------------NIQL-----SGSES------------ 851
Kv8.1    --------------------------------------------------------------
Kv8.2    --------------------------------------------------------------
Kv9.1    --------------------------------------------------------------
Kv9.2    --------------------------------------------------------------
Kv9.3    --------------------------------------------------------------
Kv10.1   -----VSFQAA-----------------S--------TSGVPDHAKLQAPGS--------- 819
Kv10.2   -----MELKPN-----------------GGA------DQKCLKVNSPIRMKN--------- 805
Kv11.1   -----SGAFSG-----------------VSNIFSFWGDSRGRQYQELPRCPAPT------ 1019
Kv11.2   -----LKLGSR-----------------LEQLQAQMNRLESRVS-------S--------- 842
Kv11.3   -----DKRSHS-----------------CKDITDMRSWERENAHPQPEDS---------- 1007
Kv12.1   -----DGIEDG-----------------NSSEE----SQTFDFGSERIRSEPRIS------ 843
Kv12.2   -----DGIEDG-----------------CGSDQPKFSFPVGQSGPECSSSPSPG------ 857
Kv12.3   -----DGIEDS-----------------GS-------TAEAPSFRFSR------------ 847
HCN1     -----VGESLA-----------------SIPQPVTAVPGTGLQ---------- 828
HCN2     -----LPHGAP-----------------G--------PAASTR---------- 839
HCN3     -----LPAPPA-----------------R--------TLHASLS--------- 684
HCN4     -----G-ASPV-----------------GF-------TPRGGLSPPGHSPGPPRTFP----- 1039
```

Figure 15BJ

```
CatSper1    ----KLLEDSLTEL---------------RAAEPKEVASEGTMLKRLIEKKFGTMTEKQ 735
CatSper2    ----------------------------------------------------------
CatSper3    ----------------------------------------------------------
CatSper4    ----------------------------------------------------------
Hv1         ----------------------------------------------------------
KCa1.1      ------SQCTKRYVITNPPYEFELVPTDLIFCLMQFDHNAGQSPASLSHSSHSSQSSSKKS 1149
KCa4.1      ----AGTGGS-----------------SQ------GRHTGGGDPAEHPLLRRK----- 1108
KCa4.2      ----RSNHRN-----------------ST------SSDQSD-----HPLLRRK----- 1013
TPC1        ----------------------------------------------------------

Shaker      ----------------------------------------------------------
Nav1.1      KGGA--NLLIKEDMIIDRINEN------------------------------------ 1967
Nav1.2      KECD--GTPIKEDTLIDKLNEN------------------------------------ 1957
Nav1.3      KGRI--DLPIKQDMIIDKLNGN------------------------------------ 1952
Nav1.4      GSGD--DAPEKEGLLANTMSKMY----------------------------------- 1780
Nav1.5      SGLSEEDAPEREGLIAYVMSENF----------------------------------- 1956
Nav1.6      LENG--G----THREKKES--------------------------------------- 1937
Nav1.7      DRDD--DLLNKKDMAFDNVNEN------------------------------------ 1929
Nav1.8      RAEEEAASLPDEGFVAFTANEN------------------------------------ 1902
Nav1.9      GDQN--------DLENGPHSPL------------------------------------ 1770
Cav1.1      ----VDNFLERTNSLPPV-----------MANQRPLQFAEIEMEEMESPV-------- 1642
Cav1.2      ----YPST--VSTVEGHGPPLSPAIRVQEVAWKLSS---NRMHCCDMLDGGTFPPALGPR 1794
Cav1.3      ----SENG--HHSSHKHD--------REPQRPSSVK---RTRYYETYIRSD-------S 1815
Cav1.4      ----SFGP--SDDDRGTP----------TSSQPSV---PQAGSNTHRRGS-------- 1711
Cav2.1      ----MPNSQPNSQSVEM---------------REMG------RD------------- 2079
Cav2.2      PGLESQGRAASMPRLAAETQPV-------TDASPMK------RSISTLAQR-------- 2028
Cav2.3      -----PSSMRRSFSTIR---------------DKRS------NSSWLEEFS-------- 1976
Cav3.1      KS--------GVSRTHSLPN-------------------------------------- 2049
Cav3.2      GSLQ----SPPRSPRPAS---------------------------------------- 2066
Cav3.3      ECFYPLSSTAVSPDPENFLCEME----------------------------------- 1891
Kv1.1       ----------------------------------------------------------
Kv1.2       ----------------------------------------------------------
Kv1.3       ----------------------------------------------------------
Kv1.4       ----------------------------------------------------------
Kv1.5       ----------------------------------------------------------
Kv1.6       ----------------------------------------------------------
Kv1.7       ----------------------------------------------------------
Kv1.8       ----------------------------------------------------------
Kv2.1       TRDQSI---------------------------------------------------- 858
Kv2.2       TRETSM---------------------------------------------------- 911
Kv3.1       ----------------------------------------------------------
Kv3.2       ----------------------------------------------------------
Kv3.3       ----------------------------------------------------------
Kv3.4       ----------------------------------------------------------
Kv4.1       ----------------------------------------------------------
Kv4.2       ----------------------------------------------------------
Kv4.3       ----------------------------------------------------------
Kv5.1       ----------------------------------------------------------
Kv6.1       ----------------------------------------------------------
Kv6.2       ----------------------------------------------------------
Kv6.3       ----------------------------------------------------------
Kv6.4       ----------------------------------------------------------
Kv7.1       ----------------------------------------------------------
Kv7.2       ---------QSKENLD------------------------------------------ 815
Kv7.3       ---------QDRDD-Y------------------------------------------ 816
Kv7.4       ---------SGTSASL------------------------------------------ 652
Kv7.5       ---------SGSRGSQ------------------------------------------ 858
Kv8.1       ----------------------------------------------------------
Kv8.2       ----------------------------------------------------------
Kv9.1       ----------------------------------------------------------
Kv9.2       ----------------------------------------------------------
Kv9.3       ----------------------------------------------------------
```

Figure 15BK

```
Kv10.1       ----------ECLGPKGG--------------------------------  827
Kv10.2       ----------GNGKGWLR--------------------------------  813
Kv11.1       -----PSLLNIPLSSP----------------------------------  1030
Kv11.2       --------DLSRILQLLQ--------------------------------  852
Kv11.3       --------SPSALQRAAW--------------------------------  1017
Kv12.1       ------PPLGDPEIGAA---------------------------------  854
Kv12.2       ------PE-SGLLTVPH---------------------------------  867
Kv12.3       ---------RPELPRPR---------------------------------  855
HCN1         ----------AGGRSTV---------------------------------  835
HCN2         -----------PASSSTP--------------------------------  846
HCN3         -----------RAGRSQV--------------------------------  691
HCN4         -------SAPPRASGSRG--------------------------------  1050
CatSper1     QELLFHYLQLVASVEQEQQKFR----------------------------  757
CatSper2     --------------------------------------------------
CatSper3     --------------------------------------------------
CatSper4     --------------------------------------------------
Hv1          --------------------------------------------------
KCa1.1       SSVHSIPSTANRQNRPKS--------------------------------  1167
KCa4.1       ----------SLQWARRL--------------------------------  1116
KCa4.2       ----------SMQWARRL--------------------------------  1021
TPC1         --------------------------------------------------

Shaker       --------------------------------------------------
Nav1.1       ---------------SITEKTDLTMS---TAA--CPPSYDRVT------KPIVEK------  1996
Nav1.2       ---------------STPEKTDMTPS---TT---SPPSYDSVT------KPEKEKFEKDKS  1991
Nav1.3       ---------------STPEKTDGSSS---TT---SPPSYDSVT------KPDKEKFEKDKP  1986
Nav1.4       ---------------GRENGNSSSPSPEEKGE----AGDAGPTMGLMPISPSDTAWPPAPP  1822
Nav1.5       ---------------SRPLGPPSSSISSTSFPPSYDSVTRATSDNLQVRGSDYSHSEDLA  2002
Nav1.6       ---------------TPSTASLPS---YD------SVTKPE------KEKQQRAEEGRR  1966
Nav1.7       ---------------SSPEKTDATSS---TT---SPPSYDSVT------KPDKEKYEQDRT  1963
Nav1.8       ---------------CVLPDKSETAS--ATSFPPSYESVTRGL------SDRVNMRTSSSI  1940
Nav1.9       ----------------QFLCNGDL-------SSFGVAKGK--------VHCD------  1791
Cav1.1       ---------------FLEDFPQDPRTNP---LARANTNMANANVAYANSNH------SN  1677
Cav1.2       RAPPCLHQQLQG-----SLAGL-REDTPCIV-PGHASLCCSSRVGEWLPAGCTAPQHARC  1847
Cav1.3       GDEQLPTICREDPEIHGYFRDP-HCLGEQEY-FSSEE-CYEDDSSPTWSRQNY-----GY  1867
Cav1.4       GALIF-TIPEEG--------NSQPKGTKGQNK-QDEDEEVPDRLSYLDEQAGTP-----PC  1757
Cav2.1       --------------------GYSDSEHYLPME--GQGRAASMPRLPAENQRRR--------  2110
Cav2.2       ----------------PRGTHLCSTTPDRPPPSQASSHHHHRCHRRRDRKQ----RSL  2067
Cav2.3       ---------------MERSSENTYKSRR-----RSYHSSLRLSAHRLNSD------SGH  2009
Cav3.1       --------------------DSYMCRHGSTAEGPLGHRGWGLPK--------AQSGSVL  2080
Cav3.2       --------------------VKTRKHTFGQRCVSSRPAAPGGEE---------AEASDPA  2097
Cav3.3       ---------------EIPFNPVRSWLKHDSSQAPPSPFSPDASSPLLPMPAEFFHPAVS--  1935
Kv1.1        --------------------------------------------------
Kv1.2        --------------------------------------------------
Kv1.3        --------------------------------------------------
Kv1.4        --------------------------------------------------
Kv1.5        --------------------------------------------------
Kv1.6        --------------------------------------------------
Kv1.7        --------------------------------------------------
Kv1.8        --------------------------------------------------
Kv2.1        --------------------------------------------------
Kv2.2        --------------------------------------------------
Kv3.1        --------------------------------------------------
Kv3.2        --------------------------------------------------
Kv3.3        --------------------------------------------------
Kv3.4        --------------------------------------------------
Kv4.1        --------------------------------------------------
Kv4.2        --------------------------------------------------
Kv4.3        --------------------------------------------------
Kv5.1        --------------------------------------------------
Kv6.1        --------------------------------------------------
Kv6.2        --------------------------------------------------
```

Figure 15BL

```
Kv6.3      ------------------------------------------------------
Kv6.4      ------------------------------------------------------
Kv7.1      ------------------------------------------------------
Kv7.2      -------------------ALNSCYAAVAPC-----AKV--------------  830
Kv7.3      -------------------VFGPNGGSSW-------MRE--------------  829
Kv7.4      -------------------GAVQVPLFDP------------------------  662
Kv7.5      -------------------DFYPKWRESKLFITDEEVGP--------------  878
Kv8.1      ------------------------------------------------------
Kv8.2      ------------------------------------------------------
Kv9.1      ------------------------------------------------------
Kv9.2      ------------------------------------------------------
Kv9.3      ------------------------------------------------------
Kv10.1     -------------------GGDCAKRKSW-------ARFKDACG----------KSE-  848
Kv10.2     -------------------LKNNMGAHEE-------KKEDWNNV----------TKAE  835
Kv11.1     -------------------GRRPRGDVES-------RLDALQRQLNRL----ETRLS  1057
Kv11.2     -------------------KPMPQGHASYI--LEAPASNDLALVPIASE----TTSP-  884
Kv11.3     -------------------GISETESDLTY--GEVEQRLDLLQEQLNRLESQMTTDIQ  1054
Kv12.1     -------------------VLFI-KAEETKQQINKLNSEVTTLTQEVSQLG---KDMR  889
Kv12.2     -------------------GPSEARNTDT---LDKLRQAVTELSEQVLQMREGLQSLR  903
Kv12.3     -------------------SQAPPTGTRPSPELASEAEEVKE-----------KVCR  882
HCN1       -------------------PQRVTLFRQM-------SSG---------------  848
HCN2       -------------------RLGPTPAAR--------AA----------------  857
HCN3       -------------------SLLGPPPGG--------GGR---------------  703
HCN4       -------------------SLLLPPASSPPPPQVPQRRGTPPLTPGRLTQDLKLISAS  1089
CatSper1   -------------------SQAAVIDEIVDTTFEAGEEDFRN------------  780
CatSper2   ------------------------------------------------------
CatSper3   ------------------------------------------------------
CatSper4   ------------------------------------------------------
Hv1        ------------------------------------------------------
KCa1.1     -------------------RESRDKQNRKEMVYR--------------------  1182
KCa4.1     -------------------SRKAPKQAG--------------------------  1125
KCa4.2     -------------------SRKGPKHSG--------------------------  1030
TPC1       ------------------------------------------------------

Shaker     ------------------------------------------------------
Nav1.1     -HEQEGKDE---------------------------KAKGK------------  2009
Nav1.2     EKEDKGKDI---------------------------RESKK------------  2005
Nav1.3     EKESKGKEV---------------------------RENQK------------  2000
Nav1.4     PGQTVRPGV---------------------------KESLV------------  1836
Nav1.5     DFPPSPDRD---------------------------RESIV------------  2016
Nav1.6     ERAKRQKEV---------------------------RESKC------------  1980
Nav1.7     EKEDKGKDS---------------------------KESKK------------  1977
Nav1.8     QNEDEATSMELI------------------------APGP-------------  1956
Nav1.9     ------------------------------------------------------
Cav1.1     SHVFSSVHYER-------------------------EFPEETETPAT------  1699
Cav1.2     HSRESQAAMAGQEETSQDETYEVKMNHDTEACSEPSLLSTEMLSYQDDENRQLTLP----  1903
Cav1.3     YSR-YPGRNID---------SERPRGYHHPQGFL---EDDDSPVCYDSRRS---------  1905
Cav1.4     SVLLPPHRAQR-------------------------YMDGHLVP---------  1776
Cav2.1     ------GRPRG-------------------------NNLSTISD---------  2123
Cav2.2     EKGPSLSADMD-------------------------GAPSSAVGPGLPPGEGP  2095
Cav2.3     KSDTHPSGGPE-------------------------RRRSKERKHL-------  2030
Cav3.1     SVHSQPADTSYI------------------------LQLPKDAPHLLQPHSAPT  2110
Cav3.2     DEEV---SHIT-------------------------SSA------CPWQP    2113
Cav3.3     ASQK---GPEK-------------------------GTG------TGTLP    1951
Kv1.1      ------------------------------------------------------
Kv1.2      ------------------------------------------------------
Kv1.3      ------------------------------------------------------
Kv1.4      ------------------------------------------------------
Kv1.5      ------------------------------------------------------
Kv1.6      ------------------------------------------------------
Kv1.7      ------------------------------------------------------
Kv1.8      ------------------------------------------------------
```

Figure 15BM

```
Kv2.1      ------------------------------------------------------------
Kv2.2      ------------------------------------------------------------
Kv3.1      ------------------------------------------------------------
Kv3.2      ------------------------------------------------------------
Kv3.3      ------------------------------------------------------------
Kv3.4      ------------------------------------------------------------
Kv4.1      ------------------------------------------------------------
Kv4.2      ------------------------------------------------------------
Kv4.3      ------------------------------------------------------------
Kv5.1      ------------------------------------------------------------
Kv6.1      ------------------------------------------------------------
Kv6.2      ------------------------------------------------------------
Kv6.3      ------------------------------------------------------------
Kv6.4      ------------------------------------------------------------
Kv7.1      ------------------------------------------------------------
Kv7.2      ------------------------------------------------------------
Kv7.3      ------------------------------------------------------------
Kv7.4      ------------------------------------------------------------
Kv7.5      ------------------------------------------------------------
Kv8.1      ------------------------------------------------------------
Kv8.2      ------------------------------------------------------------
Kv9.1      ------------------------------------------------------------
Kv9.2      ------------------------------------------------------------
Kv9.3      ------------------------------------------------------------
Kv10.1     ------------------------------------------------------------
Kv10.2     ------------------------------------------------------------
Kv11.1     A----------------------------------------------------------- 1058
Kv11.2     ------------------------------------------------------------
Kv11.3     TILQLL------------------------------------------------------ 1060
Kv12.1     NVIQLLENVLSP----------------------------------Q------------- 902
Kv12.2     QAVQLVLAPHRE----------------------------------G------------- 916
Kv12.3     LNQEY------------------------------------------------------- 887
HCN1       ------------------------------------------------------------
HCN2       ------------------------------------------------------------
HCN3       ------------------------------------------------------------
HCN4       QPALPQDGAQTL------------------------------------------------ 1101
CatSper1   ------------------------------------------------------------
CatSper2   ------------------------------------------------------------
CatSper3   ------------------------------------------------------------
CatSper4   ------------------------------------------------------------
Hv1        ------------------------------------------------------------
KCa1.1     ------------------------------------------------------------
KCa4.1     ------------------------------------------------------------
KCa4.2     ------------------------------------------------------------
TPC1       ------------------------------------------------------------

Shaker     ------------------------------------------------------------
Nav1.1     ------------------------------------------------------------
Nav1.2     ------------------------------------------------------------
Nav1.3     ------------------------------------------------------------
Nav1.4     ------------------------------------------------------------
Nav1.5     ------------------------------------------------------------
Nav1.6     ------------------------------------------------------------
Nav1.7     ------------------------------------------------------------
Nav1.8     ------------------------------------------------------------
Nav1.9     ------------------------------------------------------------
Cav1.1     --RGRAL---------------GQPC------------------------------RS 1710
Cav1.2     EEDKRDIRQSPKPGFLRSASLGRPASFHLECLKRQKDRGGDISQKTVLPLHLVHHQALAV 1963
Cav1.3     --PRRRLLPPTPAS--HRRSSFNFECLRRQSSQEEVPSSPIFPHRTALPLHLMQQQIMAV 1961
Cav1.4     ----RRRLLPPTPAG--------RKPSFTIQCLQRQGSCEDLPIPGTY---------HR 1814
Cav2.1     TSPMKRSASVLGPK--------AR-------------RLDD---------------YSL 2146
Cav2.2     TGCRRERERRQERG--------RSQERRQPSSSSSEKQRFYS--------------CDR 2132
```

Figure 15BN

```
Cav2.3    LSPDVSRCNSEERGT-----QADWESPERRQSRSPSEGRSQ---------------TPN  2069
Cav3.1    WGTIPKLPPPGRSPLAQRPLRRQAAIRTDSLDVQGLGSREDLLAEVSGPSPPLARAYSFW  2170
Cav3.2    TAEP---HGPEASPVAG----GERDLRRLY-----SVDA------QGFLDKP-GRADEQW  2154
Cav3.3    KIALQGSWASLRSPRVNCTLLRQATGSDTSLDASPSSSA------GSLQTTLEDSLTLSD  2005
Kv1.1     ------------------------------------------------------------
Kv1.2     ------------------------------------------------------------
Kv1.3     ------------------------------------------------------------
Kv1.4     ------------------------------------------------------------
Kv1.5     ------------------------------------------------------------
Kv1.6     ------------------------------------------------------------
Kv1.7     ------------------------------------------------------------
Kv1.8     ------------------------------------------------------------
Kv2.1     ------------------------------------------------------------
Kv2.2     ------------------------------------------------------------
Kv3.1     ------------------------------------------------------------
Kv3.2     ------------------------------------------------------------
Kv3.3     ------------------------------------------------------------
Kv3.4     ------------------------------------------------------------
Kv4.1     ------------------------------------------------------------
Kv4.2     ------------------------------------------------------------
Kv4.3     ------------------------------------------------------------
Kv5.1     ------------------------------------------------------------
Kv6.1     ------------------------------------------------------------
Kv6.2     ------------------------------------------------------------
Kv6.3     ------------------------------------------------------------
Kv6.4     ------------------------------------------------------------
Kv7.1     ------------------------------------------------------------
Kv7.2     ----------------------------RPYIAEGESDT--------------------  841
Kv7.3     ----------------------------KRYLAEGETDT--------------------  840
Kv7.4     ----------------------------DITSDYHSP----------------------  671
Kv7.5     ----------------------------EETETDTFDAAPQPA----------------  893
Kv8.1     ------------------------------------------------------------
Kv8.2     ------------------------------------------------------------
Kv9.1     ------------------------------------------------------------
Kv9.2     ------------------------------------------------------------
Kv9.3     ------------------------------------------------------------
Kv10.1    ------------------------DWNKVSKAESMETL---------------------  862
Kv10.2    ------------------------SMGLLSEDPKSSD----------------------  848
Kv11.1    ------------------------DMATVLQLLQRQM----------------------  1071
Kv11.2    ------------------------GPRLPQGFLPPAQ----------------------  897
Kv11.3    ------------------------QKQTTVVPPAYSMV---------------------  1074
Kv12.1    ---------------------QPSRFCSLHSTSVCPSRESLQ-----------------  923
Kv12.2    ---------------------PCPRASGEGPCPASTSGLLQP-----------------  937
Kv12.3    ------------------------SRLNQEVSQLSREL--------------------  901
HCN1      ------------------------AIPPNRGVPPAPPPP-------------------  863
HCN2      ------------------------APSPDRPD-SASP---------------------  869
HCN3      ------------------------RLGPRGRPLSASQPS-------------------  718
HCN4      ------------------------RRASPHSSGESMAAFP------------------  1117
CatSper1  ------------------------------------------------------------
CatSper2  ------------------------------------------------------------
CatSper3  ------------------------------------------------------------
CatSper4  ------------------------------------------------------------
Hv1       ------------------------------------------------------------
KCa1.1    ------------------------------------------------------------
KCa4.1    ---------------------RAAAAEWISQQRLSLYRR--------------------  1143
KCa4.2    ---------------------KTAEKITQQ--RLNLYRR--------------------  1046
TPC1      ------------------------------------------------------------
```

Figure 15BO

```
Shaker    ------------------------------------------------------------
Nav1.1    ------------------------------------------------------------
Nav1.2    ------------------------------------------------------------
Nav1.3    ------------------------------------------------------------
Nav1.4    ------------------------------------------------------------
Nav1.5    ------------------------------------------------------------
Nav1.6    ------------------------------------------------------------
Nav1.7    ------------------------------------------------------------
Nav1.8    ------------------------------------------------------------
Nav1.9    ------------------------------------------------------------
Cav1.1    LGP------HSKPCVEMLKGLLTQ---------RAMP-----------------PGQAPP 1738
Cav1.2    AGLSPLLQRSHSPAS-FPRPFATPPATP---GSRGWPPQPVPTLRLEGVESSE-KLNSSF 2018
Cav1.3    AGLDSSKAQKYSPSH-STRSWATPPATP---PYRDWTF--CYTPLIQVEQSEALDQVNGS 2015
Cav1.4    GR-------NSGPNR-AQGSWATPP-------QRGRLL---------------YAP 1840
Cav2.1    ERVPPEENQRHHQRRR---------------DRSHR------------------ASE 2170
Cav2.2    FGGREPPKPKPSLSSHPTSPTAGQEPGPHPQGSGSV---------------------NGS 2171
Cav2.3    RQGTGSLSESSIPSVSDTSTP----------RRSPRQLP-----------PVPPKPR 2105
Cav3.1    GQSSTQAQQHSRSHSKISKHMTPPAPCPGPEPNWGKGPPETRSSLELDTELSWISGDLLP 2230
Cav3.2    RPSAELGSGEPGEAKAWGPEAEPALGARR---KKKMSPPCISVEPPAEDEGSARPSAAEG 2211
Cav3.3    SPRRALGPPAPAPGPRAGLSPA-ARRRLS---LRGRGLFSLRGL--RAHQRSHSSGGSTS 2059
Kv1.1     ------------------------------------------------------------
Kv1.2     ------------------------------------------------------------
Kv1.3     ------------------------------------------------------------
Kv1.4     ------------------------------------------------------------
Kv1.5     ------------------------------------------------------------
Kv1.6     ------------------------------------------------------------
Kv1.7     ------------------------------------------------------------
Kv1.8     ------------------------------------------------------------
Kv2.1     ------------------------------------------------------------
Kv2.2     ------------------------------------------------------------
Kv3.1     ------------------------------------------------------------
Kv3.2     ------------------------------------------------------------
Kv3.3     ------------------------------------------------------------
Kv3.4     ------------------------------------------------------------
Kv4.1     ------------------------------------------------------------
Kv4.2     ------------------------------------------------------------
Kv4.3     ------------------------------------------------------------
Kv5.1     ------------------------------------------------------------
Kv6.1     ------------------------------------------------------------
Kv6.2     ------------------------------------------------------------
Kv6.3     ------------------------------------------------------------
Kv6.4     ------------------------------------------------------------
Kv7.1     ------------------------------------------------------------
Kv7.2     ----------------DSDLCT----------------------------PCGPPPR 854
Kv7.3     ----------------DTDPFT----------------------------PSGSMPL 853
Kv7.4     ----------------VDHEDI----------------------------SVSAQTL 684
Kv7.5     -------------REAAFASDSLRT-------------------------GRSRSSQ 912
Kv8.1     ------------------------------------------------------------
Kv8.2     ------------------------------------------------------------
Kv9.1     ------------------------------------------------------------
Kv9.2     ------------------------------------------------------------
Kv9.3     ------------------------------------------------------------
Kv10.1    ----------PERTKASGE-----------------------------ATLK 875
Kv10.2    -------------SENSVTK----------------------------NPLR 859
Kv11.1    -------------TLVPPAYS---------------------------AV--- 1081
Kv11.2    -------------TPSYGDLD---------------------------DCSP 909
Kv11.3    -------------TAGSEYQRPIIQLM--------------------RTSQPEASIK 1098
Kv12.1    ---------T--RTSWSAHQPCLHLQTGGAA------------------YTQAQLCSSNITS 956
Kv12.2    ------------LCVDTGASSYCL------------------------QPPAGSVLSG 959
Kv12.3    ---------------RHIMGLLQA------------------------RLGPPG 916
HCN1      ---------------AAA------------------------------LPRESS 872
HCN2      ---------------GAA------------------------------GGLDPQ 878
HCN3      -----------LPQ---RAT----------------------------GDGSPG 730
```

Figure 15BP

```
HCN4       --------LFP---RA-----------------------------------GGGSGG 1128
CatSper1   ------------------------------------------------------------
CatSper2   ------------------------------------------------------------
CatSper3   ------------------------------------------------------------
CatSper4   ------------------------------------------------------------
Hv1        ------------------------------------------------------------
KCa1.1     ------------------------------------------------------------
KCa4.1     SERQELSELVKNRMKHLGLP----------------------------TTGYDEMNDHQN 1175
KCa4.2     SERQELAELVKNRMKHLGLS----------------------------TVGYDEMNDHQS 1078
TPC1       ------------------------------------------------------------

Shaker     ------------------------------------------------------------
Nav1.1     ------------------------------------------------------------
Nav1.2     ------------------------------------------------------------
Nav1.3     ------------------------------------------------------------
Nav1.4     ------------------------------------------------------------
Nav1.5     ------------------------------------------------------------
Nav1.6     ------------------------------------------------------------
Nav1.7     ------------------------------------------------------------
Nav1.8     ------------------------------------------------------------
Nav1.9     ------------------------------------------------------------
Cav1.1     APCQCPRVESSMPE----DRKSSTP------------G---SLHEETPHSRSTRENTSR 1778
Cav1.2     PSIHCGSWAETTPG----GGGSSAAR--------RVRPV---SLMVPSQAGAPGRQFHGS 2063
Cav1.3     LPSLHRSSWYTDEP----DISYRTFT--------PASLT---VPSSFR-NKNSDK--QRS 2057
Cav1.4     LLLVEEGAAGEGYL----GRSSGPL---------RTFT----CLHVPGTHSDPSHGKRGS 1883
Cav2.1     ---RSLG--RYTDV----DTGLGT----------DLSMT-TQSGDLPSKERDQER----- 2205
Cav2.2     PLLSTSG--ASTPG----RGGRRQLPQTPLTPRPSITYK-TANSSPIHFAGAQTSLPAFS 2224
Cav2.3     PLLSYSSLIRHAGSISPPADGSEEGSPLTSQALESNNAWLTESSNSPHPQQRQHASPQRY 2165
Cav3.1     PGGQEEPPSPRDLKKCYSVEAQSCQRRPT-------------------SWLDEQRRHSI 2270
Cav3.2     -GST-------TLRRRTPSCEATPHRDSLEP-------------TEGSGAGGDPAAKGE 2249
Cav3.3     PGCT-------HRDSMDPS---DEEGRG---------------------GAGGGGAGSEH 2088
Kv1.1      ------------------------------------------------------------
Kv1.2      ------------------------------------------------------------
Kv1.3      ------------------------------------------------------------
Kv1.4      ------------------------------------------------------------
Kv1.5      ------------------------------------------------------------
Kv1.6      ------------------------------------------------------------
Kv1.7      ------------------------------------------------------------
Kv1.8      ------------------------------------------------------------
Kv2.1      ------------------------------------------------------------
Kv2.2      ------------------------------------------------------------
Kv3.1      ------------------------------------------------------------
Kv3.2      ------------------------------------------------------------
Kv3.3      ------------------------------------------------------------
Kv3.4      ------------------------------------------------------------
Kv4.1      ------------------------------------------------------------
Kv4.2      ------------------------------------------------------------
Kv4.3      ------------------------------------------------------------
Kv5.1      ------------------------------------------------------------
Kv6.1      ------------------------------------------------------------
Kv6.2      ------------------------------------------------------------
Kv6.3      ------------------------------------------------------------
Kv6.4      ------------------------------------------------------------
Kv7.1      ------------------------------------------------------------
Kv7.2      ------------SATGEGPF-----------------------GDVGWAGPRK- 872
Kv7.3      ------------SSTGDGIS-----------------------DSVWTPSNKPI 872
Kv7.4      ------------SISRSVST-----------------------NMD-------- 695
Kv7.5      ------------SICKAGES-----------------------TDALSLPHVKL 931
Kv8.1      ------------------------------------------------------------
Kv8.2      ------------------------------------------------------------
Kv9.1      ------------------------------------------------------------
Kv9.2      ------------------------------------------------------------
```

Figure 15BQ

```
Kv9.3        ------------------------------------------------------
Kv10.1       ----------KTDSCDSGITKSDLRL--------------------DNVGE--ARSPQ 901
Kv10.2       ----------KTDSCDSGITKSDLRL--------------------DKAGE--ARSPL 885
Kv11.1       ----------TTPGPGPTSTSPLLPVSPL-----------------PTLTL----DSLS 1109
Kv11.2       ----------KHRNSSPRMPHLAVATDK------------------TLAP----SSEQ 935
Kv11.3       ----------TDRSFSPSSQCPEFLDLE------------------KSKL----KSKE 1124
Kv12.1       ----------DIWSVDPSSVGSSPQR-TG--AHEQNPADSELYHSPSLDYS---PSHYQ 999
Kv12.2       ----------TWPHPRPGPPPLMAPWPWGPPASQSSPWPRATAFWTSTSDSEPPASGDL 1008
Kv12.3       ----------HPAGSA---------W-TP--DPP-----CPQLRPPCLSPC---ASRPP 945
HCN1         ----------SVLNTDPD----------------------------AEKPRFASNL- 890
HCN2         ----------DSARSRLS--------------------------------------SNL- 889
HCN3         ----------RKGSGSERLFPS------------------------GLLAKPPRTAQ 753
HCN4         ----------SGSSGGLGPPGRPYGA--------------------IPGQHVTLPRKTS 1157
CatSper1     ------------------------------------------------------
CatSper2     ------------------------------------------------------
CatSper3     ------------------------------------------------------
CatSper4     ------------------------------------------------------
Hv1          ------------------------------------------------------
KCa1.1       ------------------------------------------------------
KCa4.1       ----------TLSYVLINPPPDTRLEP-------------------SDIVYLIRSDP 1203
KCa4.2       ----------TLSYILINPSPDTRIEL-------------------NDVVYLIRPDP 1106
TPC1         ------------------------------------------------------

Shaker       ------------------------------------------------------
Nav1.1       ------------------------------------------------------
Nav1.2       ------------------------------------------------------
Nav1.3       ------------------------------------------------------
Nav1.4       ------------------------------------------------------
Nav1.5       ------------------------------------------------------
Nav1.6       ------------------------------------------------------
Nav1.7       ------------------------------------------------------
Nav1.8       ------------------------------------------------------
Nav1.9       ------------------------------------------------------
Cav1.1       CSAPATALLIQK---------------------ALVRGGLGTLAADANFIMAT-GQALGD 1816
Cav1.2       ASSLVEA------------------------------VLISEGLGQFAQDPKFIEVT-TQELAD 2096
Cav1.3       ADSLVEA------------------------------VLISEGLGRYARDPKFVSAT-KHEIAD 2090
Cav1.4       ADSLVEA------------------------------VLISEGLGLFARDPRFVALA-KQEIAD 1916
Cav2.1       -GRPKDRKH-----------------------------RQHHHHH--------------HH 2222
Cav2.2       PGRLSRGLSEHNALLQRDPLSQPLAPGSRIGSDPYLGQRLDSEASVHALPEDTLTFEEAV 2284
Cav2.3       ISEPYLALHED-----------------------SHASDCVEEETL-TFEAAV 2194
Cav3.1       AVSCLDSG---SQPHLGTDPSNLGGQFLGGPGSRPKKKLSPPSITIDPPESQGPRTPPSPG 2328
Cav3.2       RWGQASCRAEHLTVPSFAFEPLDL----GVPSGDPFLD---------G-----SHSVTPESRA 2294
Cav3.3       SETLSSLSLTSLFCPPPPPPAPGLTPARKFSSTSSLA-----------APGRPHAAALAHGLA 2140
Kv1.1        ------------------------------------------------------
Kv1.2        ------------------------------------------------------
Kv1.3        ------------------------------------------------------
Kv1.4        ------------------------------------------------------
Kv1.5        ------------------------------------------------------
Kv1.6        ------------------------------------------------------
Kv1.7        ------------------------------------------------------
Kv1.8        ------------------------------------------------------
Kv2.1        ------------------------------------------------------
Kv2.2        ------------------------------------------------------
Kv3.1        ------------------------------------------------------
Kv3.2        ------------------------------------------------------
Kv3.3        ------------------------------------------------------
Kv3.4        ------------------------------------------------------
Kv4.1        ------------------------------------------------------
Kv4.2        ------------------------------------------------------
Kv4.3        ------------------------------------------------------
Kv5.1        ------------------------------------------------------
Kv6.1        ------------------------------------------------------
```

Figure 15BR

```
Kv6.2      ------------------------------------------------------------
Kv6.3      ------------------------------------------------------------
Kv6.4      ------------------------------------------------------------
Kv7.1      ------------------------------------------------------------
Kv7.2      ------------------------------------------------------------
Kv7.3      ------------------------------------------------------------
Kv7.4      ------------------------------------------------------------
Kv7.5      K----------------------------------------------------------- 932
Kv8.1      ------------------------------------------------------------
Kv8.2      ------------------------------------------------------------
Kv9.1      ------------------------------------------------------------
Kv9.2      ------------------------------------------------------------
Kv9.3      ------------------------------------------------------------
Kv10.1     DRSPILAEVKHSFYPIPEQTLQATVLEVRHELKEDI--------------------KAL 940
Kv10.2     ERSPIQADARHPFYPIPEQALQTTLQEVKHELKEDI--------------------QLL 924
Kv11.1     QVSQFMACEELPP-------------GAPE--------------------------LP 1128
Kv11.2     EQPEGLWPPLASP-------------LHPL--------------------------EV 954
Kv11.3     SLSSGVHLNTASE-------------DNLT--------------------------SL 1143
Kv12.1     VVQEGHLQFLRCI---------SPHSDSTLTPLQSI---------------SATLSSSV 1034
Kv12.2     CSEPST---PASPPP--------SEEGART---------------------------GPA 1030
Kv12.3     PSLQDTTLAEVH----------CPASVGT----------------------MET--GTA 970
HCN1       ------------------------------------------------------------
HCN2       ------------------------------------------------------------
HCN3       PPRPP-------------------VPEPATPRGLQLS---------------ANM----- 774
HCN4       SGSLPPPLSLFGARATSSGGPPLTAGPQREPGARPEP---------------VRSKLPSN 1202
CatSper1   ------------------------------------------------------------
CatSper2   ------------------------------------------------------------
CatSper3   ------------------------------------------------------------
CatSper4   ------------------------------------------------------------
Hv1        ------------------------------------------------------------
KCa1.1     ------------------------------------------------------------
KCa4.1     LAHVASSS------------------------------------------------QSRK 1215
KCa4.2     LAYLPNSE------------------------------------------------PSRR 1118
TPC1       ------------------------------------------------------------

Shaker     ------------------------------------------------------------
Nav1.1     ------------------------------------------------------------
Nav1.2     ------------------------------------------------------------
Nav1.3     ------------------------------------------------------------
Nav1.4     ------------------------------------------------------------
Nav1.5     ------------------------------------------------------------
Nav1.6     ------------------------------------------------------------
Nav1.7     ------------------------------------------------------------
Nav1.8     ------------------------------------------------------------
Nav1.9     ------------------------------------------------------------
Cav1.1     ACQMEPEEVEIMATELLKGREAPDGMAS-------------------SLGCLNLGSSLG- 1856
Cav1.2     ACDMTIEEMESAADNILSGGAPQSPNGALLPFVNCRDAGQDRAGGEEDAGCVRAPGRPSE 2156
Cav1.3     ACDLTIDEMESAASTLLNGNVRPPANGD----VGPLSHRQDYELQDFGPGYSDEEPDPGR 2146
Cav1.4     ACRLTLDEMDNAASDLLAQGTS-SLYSD------------------EESILSRFDEEDLG- 1957
Cav2.1     HHHPPPPDKDRYAQE---RPDH--GRAR--------------------ARDQRW---SRSP 2255
Cav2.2     ATNSGRSSRTSYVSSL-TSQSHPLRRVP--------------------NGYHCTLGLSSGG 2324
Cav2.3     ATSLGRSNTIGSAPPLRHSWQMPNGHYR--------------------RRRRGGPGPGMMC 2235
Cav3.1     ICLRRRAP---------SSDSKDPLASGPPDSMAASP---SPKKDVLSLSGLSSDPADLD 2376
Cav3.2     SSSGAIVPLEPPESEPPMPVGDPPEKPRGLYLTVFQCPLEKPG-SPSATPAPGGGADDPV 2353
Cav3.3     RSPSWAA---------DRSKDPPGRAPLPMGLGPLAPPPQPLPGELEPGDAASKRKR-- 2188
Kv1.1      ------------------------------------------------------------
Kv1.2      ------------------------------------------------------------
Kv1.3      ------------------------------------------------------------
Kv1.4      ------------------------------------------------------------
Kv1.5      ------------------------------------------------------------
Kv1.6      ------------------------------------------------------------
Kv1.7      ------------------------------------------------------------
```

Figure 15BS

```
Kv1.8    ----------------------------------------------------------------
Kv2.1    ----------------------------------------------------------------
Kv2.2    ----------------------------------------------------------------
Kv3.1    ----------------------------------------------------------------
Kv3.2    ----------------------------------------------------------------
Kv3.3    ----------------------------------------------------------------
Kv3.4    ----------------------------------------------------------------
Kv4.1    ----------------------------------------------------------------
Kv4.2    ----------------------------------------------------------------
Kv4.3    ----------------------------------------------------------------
Kv5.1    ----------------------------------------------------------------
Kv6.1    ----------------------------------------------------------------
Kv6.2    ----------------------------------------------------------------
Kv6.3    ----------------------------------------------------------------
Kv6.4    ----------------------------------------------------------------
Kv7.1    ----------------------------------------------------------------
Kv7.2    ----------------------------------------------------------------
Kv7.3    ----------------------------------------------------------------
Kv7.4    ----------------------------------------------------------------
Kv7.5    ----------------------------------------------------------------
Kv8.1    ----------------------------------------------------------------
Kv8.2    ----------------------------------------------------------------
Kv9.1    ----------------------------------------------------------------
Kv9.2    ----------------------------------------------------------------
Kv9.3    ----------------------------------------------------------------
Kv10.1   NAKMTNIEKQL--------SEILRILTSRRSSQSPQELFEISRPQSPESERDIFG---AS-  989
Kv10.2   SCRMTALEKQVAEILKILSEKSVPQASSPKSQMPLQVPPQIPCQDIFSVSRPESPESDKD  984
Kv11.1   QEGPTRRLSL----------------PGQLGAL-----TSQPLHRHG----S--DPGS  1159
Kv11.2   Q-GLICGPCF-----------SSLPEHLGSVPKQL-----DFQ-RHGSDPGFAG--SWGH  994
Kv11.3   L-KQDSDLSLEL------HLRQRKTYVHPIRHPSLP-----DSSLSTVGIVGLHR--HVSD 1190
Kv12.1   CSSSETSLHL---------VLPSRSEEGSFSQGTVSS------FSLENLPGSWNQEG--MASA 1080
Kv12.2   EPVSQAEAT-------------STGEPPPGSGGLALP------WDPHSLE--MVLIG--CHGS 1070
Kv12.3   LLDL--RPSI--------LPPYPSEPDPLGPSPVPE-----ASPPTPSLLRHSFQ--SRSD 1014
HCN1     ----------------------------------------------------------------
HCN2     ----------------------------------------------------------------
HCN3     ----------------------------------------------------------------
HCN4     L-------------------------------------------------------------- 1203
CatSper1 ----------------------------------------------------------------
CatSper2 ----------------------------------------------------------------
CatSper3 ----------------------------------------------------------------
CatSper4 ----------------------------------------------------------------
Hv1      ----------------------------------------------------------------
KCa1.1   ----------------------------------------------------------------
KCa4.1   SSCSHKL------------S-SCNPETRDETQL----------------------------- 1235
KCa4.2   NSICNVT------------GQDSREETQL-------------------------------- 1135
TPC1     ----------------------------------------------------------------

Shaker   ----------------------------------------
Nav1.1   ----------------------------------------
Nav1.2   ----------------------------------------
Nav1.3   ----------------------------------------
Nav1.4   ----------------------------------------
Nav1.5   ----------------------------------------
Nav1.6   ----------------------------------------
Nav1.7   ----------------------------------------
Nav1.8   ----------------------------------------
Nav1.9   ----------------------------------------
Cav1.1   -----SLDQHQGSQETLIPPRL-------- 1873
Cav1.2   EELQDSRVYVSSL----------- 2169
Cav1.3   DEE-DLADEMICITTL----------- 2161
Cav1.4   ----DEMACVHAL-------------- 1966
Cav2.1   ----SEGPEH-MAHRQ----------- 2266
```

Figure 15BT

```
Cav2.2      ------RARHSY-HHPDQDHWC------------  2339
Cav2.3      ------GAVNNLLSDTEEDDKC------------  2251
Cav3.1      P---------------------------------  2377
Cav3.2      ----------------------------------
Cav3.3      ----------------------------------
Kv1.1       ----------------------------------
Kv1.2       ----------------------------------
Kv1.3       ----------------------------------
Kv1.4       ----------------------------------
Kv1.5       ----------------------------------
Kv1.6       ----------------------------------
Kv1.7       ----------------------------------
Kv1.8       ----------------------------------
Kv2.1       ----------------------------------
Kv2.2       ----------------------------------
Kv3.1       ----------------------------------
Kv3.2       ----------------------------------
Kv3.3       ----------------------------------
Kv3.4       ----------------------------------
Kv4.1       ----------------------------------
Kv4.2       ----------------------------------
Kv4.3       ----------------------------------
Kv5.1       ----------------------------------
Kv6.1       ----------------------------------
Kv6.2       ----------------------------------
Kv6.3       ----------------------------------
Kv6.4       ----------------------------------
Kv7.1       ----------------------------------
Kv7.2       ----------------------------------
Kv7.3       ----------------------------------
Kv7.4       ----------------------------------
Kv7.5       ----------------------------------
Kv8.1       ----------------------------------
Kv8.2       ----------------------------------
Kv9.1       ----------------------------------
Kv9.2       ----------------------------------
Kv9.3       ----------------------------------
Kv10.1      ----------------------------------
Kv10.2      EIHF------------------------------  988
Kv11.1      ----------------------------------
Kv11.2      ----------------------------------
Kv11.3      PGLPGK----------------------------  1196
Kv12.1      STKPLENLPLEVVTSTAEVKDNKAINV        1107
Kv12.2      GTVQ---------WFQEEGTGV-----        1083
Kv12.3      TFH-------------------------------  1017
HCN1        ----------------------------------
HCN2        ----------------------------------
HCN3        ----------------------------------
HCN4        ----------------------------------
CatSper1    ----------------------------------
CatSper2    ----------------------------------
CatSper3    ----------------------------------
CatSper4    ----------------------------------
Hv1         ----------------------------------
KCa1.1      ----------------------------------
KCa4.1      ----------------------------------
KCa4.2      ----------------------------------
TPC1        ----------------------------------
```

Figure 15BU

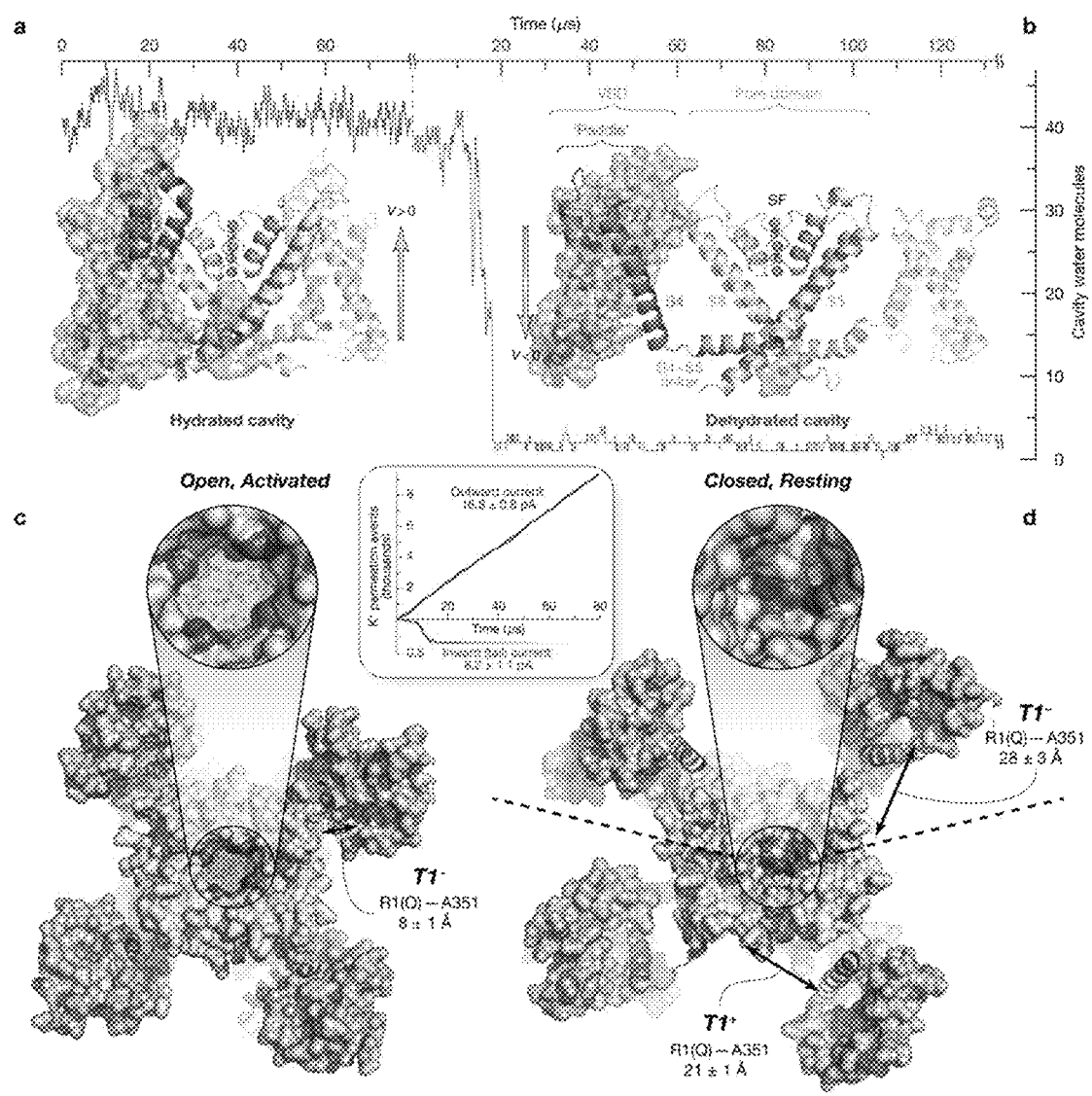
Figure 16A-D

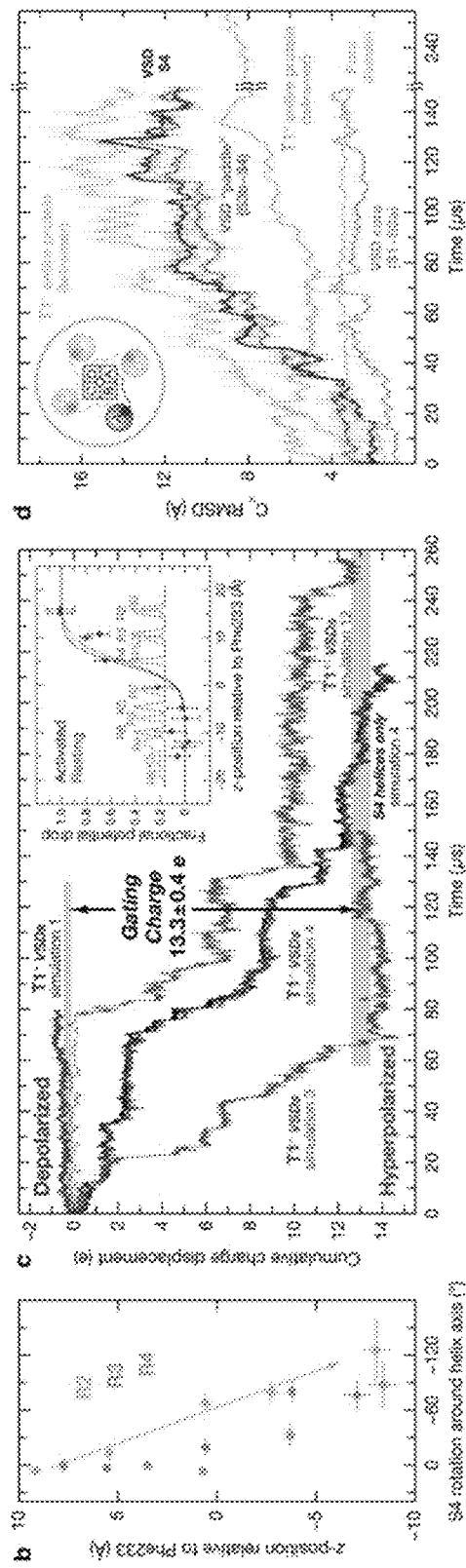
Figures 17B-D

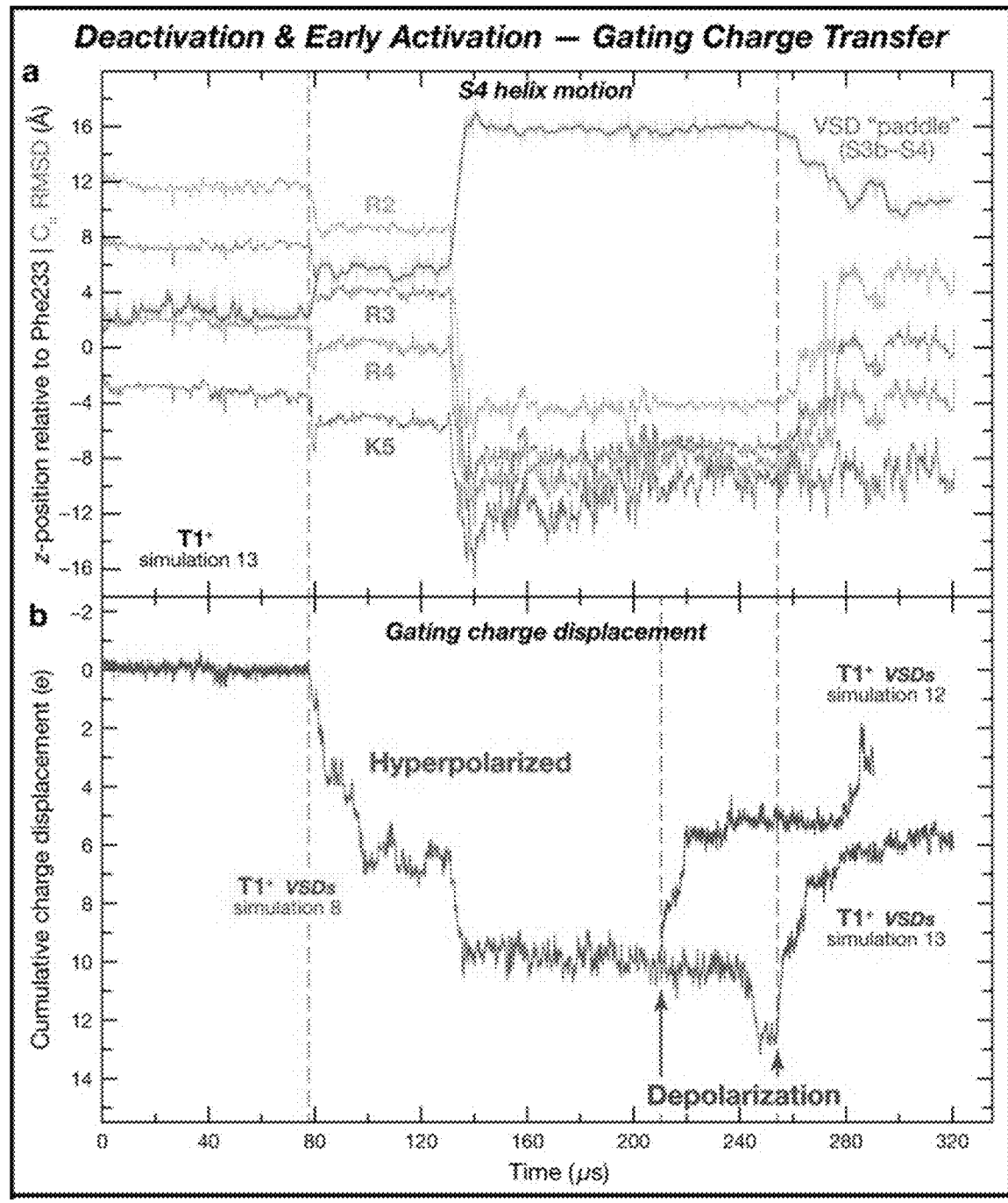
Figures 18A-B

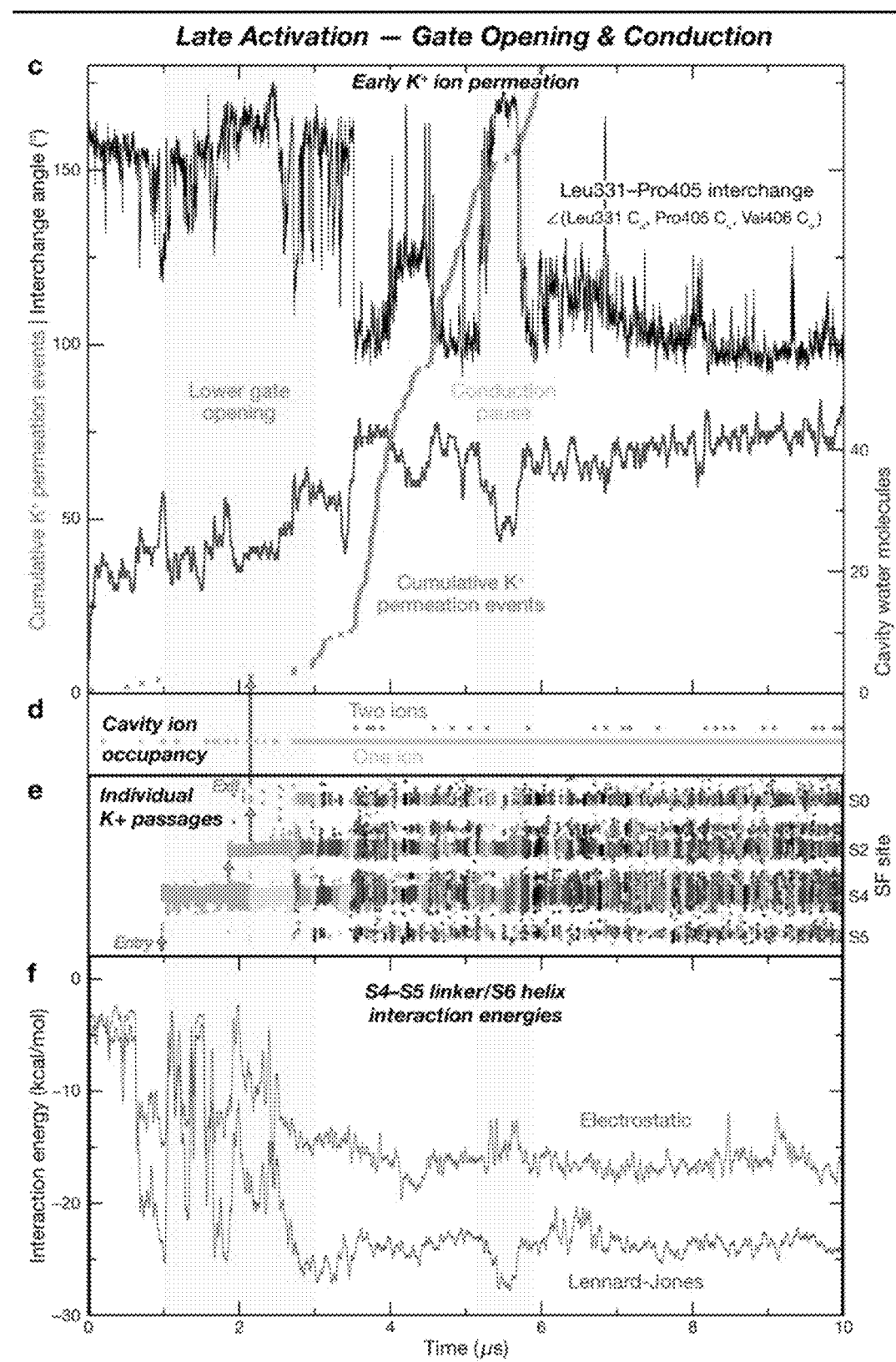
Figures 18C-F

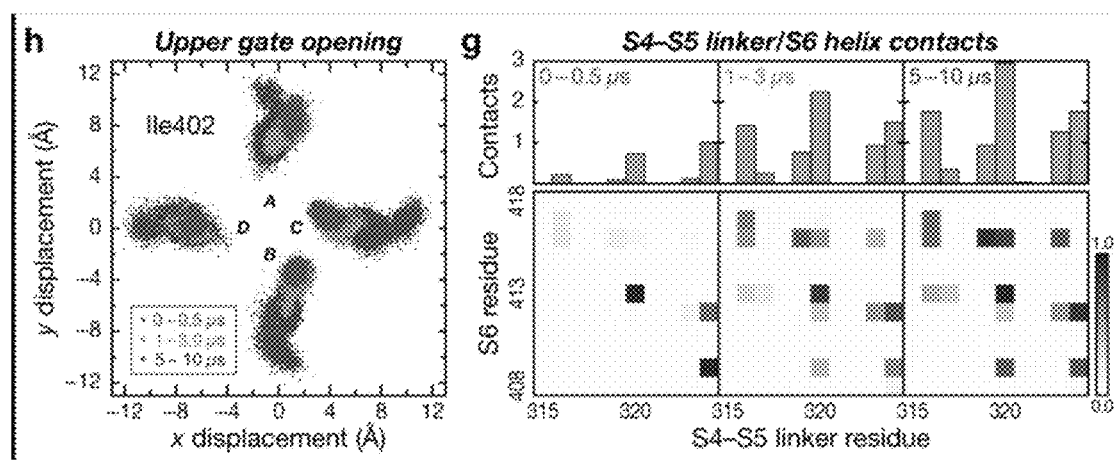
Figures 18G-H

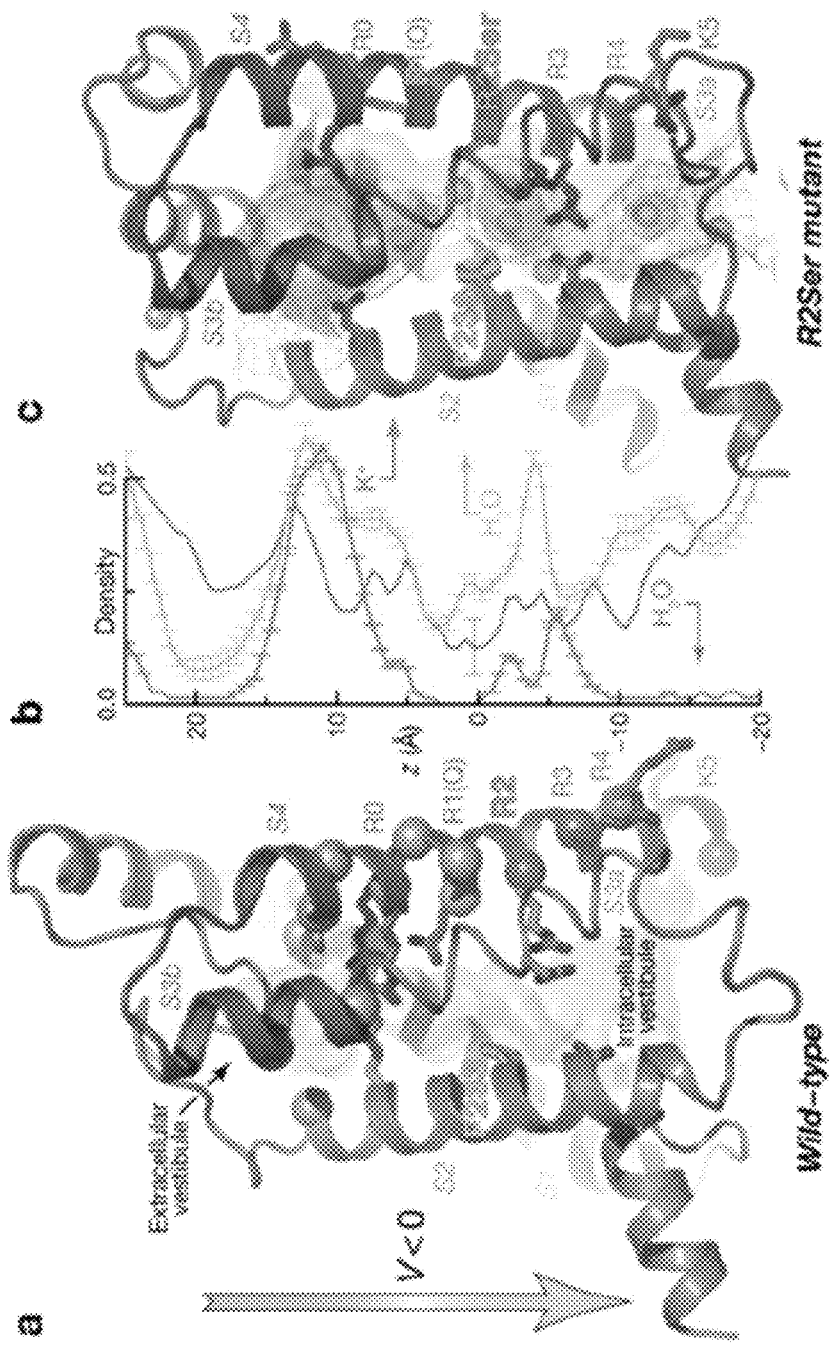
Figures 20A-C

| ID | Force Field | T1 domain | Atoms (k) | Simulation Time (μs) | Applied Voltage (mV) | Pore Half-Dewetted Time (μs) | Pore Closure Time (μs) | Gating Charge at Closure (e) | Final K's "Down" | Final Gating Charge, $q_g$ (e) |
|---|---|---|---|---|---|---|---|---|---|---|
| *Depolarizing Voltage (control)* | | | | | | | | | | |
| 1 | C27 | – | 107 | 80 | –750 | N/A | N/A | N/A | 0:0:0 | 0.56 ± 0.06 |
| 2 | DER | – | 107 | 33 | –750 | N/A | N/A | N/A | 0:0:0 | 0.13 ± 0.01 |
| 3 | DER | – | 107 | 14 | –375 | N/A | N/A | N/A | 0:0:0 | 0.12 ± 0.01 |
| 4 | DER | + | 230 | 15 | –375 | N/A | N/A | N/A | 0:0:0 | 0.46 ± 0.04 |
| *Hyperpolarizing Voltage* | | | | | | | | | | |
| 5 | DER | – | 140 | 150 | –750 (–375) | 13 | 18 | 2 | 3/3/3 | 13.33 ± 0.06 |
| 6 | DER | – | 123 | 215 | –750 (–375) | 2 | 9 | 1 | 3/3/3 | 13.37 ± 0.06 |
| 7 | DER | – | 140 | 211 | –750 | 25 | 36 | 7 | 2/2/3 | 12.90 ± 0.04 |
| 8 | DER | – | 150 | 218 | –750 | (44) | 12 | 0 | 3/3/1 | 10.56 ± 0.08 |
| 9 | DER2 | + | 230 | 256 | –375 (–500) | 33 | 80 | 4 | 3/3/3 | 12.34 ± 0.11 |
| *Depolarizing Voltage (activation)* | | | | | | | | | | |
| 10 | DER | – | 107 | 30 | +750 | 0 | N/A | N/A | 0:0:0 | 0.20 ± 0.01 |
| 11 | C27 | – | 107 | 20 | +750 | 1 | N/A | N/A | 0:0:0 | 0.83 ± 0.11 |
| 12 | DER | – | 107 | 33 | +750 | 1 | N/A | N/A | 0:0:0 | 0.88 ± 0.10 |
| 13 | DER2 | + | 230 | 101 | +375 | N/A | N/A | N/A | 2:0:0 | 2.74 ± 0.05 |
| 14 | DER2 | + | 230 | 114 | +500 | N/A | N/A | N/A | 1:0:1 | 3.48 ± 0.10 |
| *Depolarizing Voltage (control, with TIP4P water model)* | | | | | | | | | | |
| 15 | DER | – | 107 | 62 | –750 | 11 | N/A | N/A | 0:0:0 | 2.35 ± 0.02 |

Figure 21

| Aspartate | | | | Glutamate | | | | Arginine | | | |
|---|---|---|---|---|---|---|---|---|---|---|---|
| Atom(s) | Partial Charges ($e$) | | | Atom(s) | Partial Charges ($e$) | | | Atom(s) | Partial Charges ($e$) | | |
| | C27 | DER | DER2 | | C27 | DER | DER2 | | C27 | DER | DER2 |
| $C_\beta$ | −0.28 | −0.28 | −0.28 | $C_\beta$ | −0.18 | −0.18 | −0.18 | $N_\epsilon$ | −0.70 | −0.61 | −0.55 |
| $H_{\beta1}, H_{\beta2}$ | 0.09 | 0.05 | 0.09 | $H_{\beta1}, H_{\beta2}$ | 0.09 | 0.09 | 0.09 | $H_\epsilon$ | 0.44 | 0.38 | 0.29 |
| $C_\gamma$ | 0.62 | 0.56 | 0.32 | $C_\gamma$ | −0.28 | −0.28 | −0.28 | $C_\zeta$ | 0.64 | 0.49 | 0.88 |
| | | | | $H_{\gamma1}, H_{\gamma2}$ | 0.09 | 0.05 | 0.09 | | | | |
| $O_{\delta1}, O_{\delta2}$ | −0.76 | −0.69 | −0.61 | $C_\delta$ | 0.62 | 0.56 | 0.32 | $N_\eta$ | −0.80 | −0.62 | −0.50 |
| | | | | $O_{\epsilon1}, O_{\epsilon2}$ | −0.76 | −0.69 | −0.61 | $H_{\eta1}, H_{\eta2}$ | 0.46 | 0.40 | 0.25 |

Figure 22

| ID | System | Residue 226 | Voltage (mV) | Time (μs) | Current (pA) | Gating Charge, $q_g$ ($e$) |
|---|---|---|---|---|---|---|
| 1 | R2Ser | Asp | −776 | 14 (11) | 0.75 ± 0.16 | −0.23 ± 0.12 |
| 2 | R2Ser | Glu | −776 | 7 (4) | 3.61 ± 0.98 | −0.02 ± 0.05 |
| 3 | R2Ser | Glu | −407 | 134 (134) | 0.05 ± 0.04 | 0.39 ± 0.04 |
| 4 | R2Ser | Asp | +807 | 14 (14) | N/A | 2.24 ± 0.03 |
| 5 | R2Ser (C36) | Glu | −762 | 34 (34) | 0.09 ± 0.03 | −0.68 ± 0.13 |
| 6 | R0Asn | Asp | −751 | 54 (50) | 6.60 ± 1.37 | −0.32 ± 0.01 |
| 7 | R0Asn | Glu | −752 | 21 (19) | 6.50 ± 1.78 | −0.08 ± 0.07 |
| 8 | R0Asn | Asp | +781 | 24 (23) | N/A | 1.96 ± 0.02 |
| 9 | R0Asn (C36) | Glu | −736 | 20 (19) | 6.03 ± 2.53 | −0.28 ± 0.02 |

Figure 23

|  | Activated ||||||||
|  | Neutral (2.2 μs) |||| Hyperpolarized (0.7 μs) ||||
|  | Protein | K⁺ | Cl⁻ | Net charge (σ) | Protein | K⁺ | Cl⁻ | Net charge (σ) |
| extracellular | −2 | 156 | 154 | 0 | −2 | 158 | 154 | +2 |
| intracellular | +4 | 152 | 156 | 0 | +4 | 150 | 156 | −2 |
|  |  |  |  | 0 |  |  |  | −4 |
|  | Resting ||||||||
|  | Neutral (1.9 μs) |||| Hyperpolarized (1.8 μs) ||||
|  | Protein | K⁺ | Cl⁻ | Net charge (σ) | Protein | K⁺ | Cl⁻ | Net charge (σ) |
| extracellular | −8 | 155 | 144 | +3 | −8 | 156 | 144 | +4 |
| intracellular | 10 | 151 | 158 | +3 | 10 | 150 | 158 | +2 |
|  |  |  |  | 0 |  |  |  | −2 |

Figure 24A

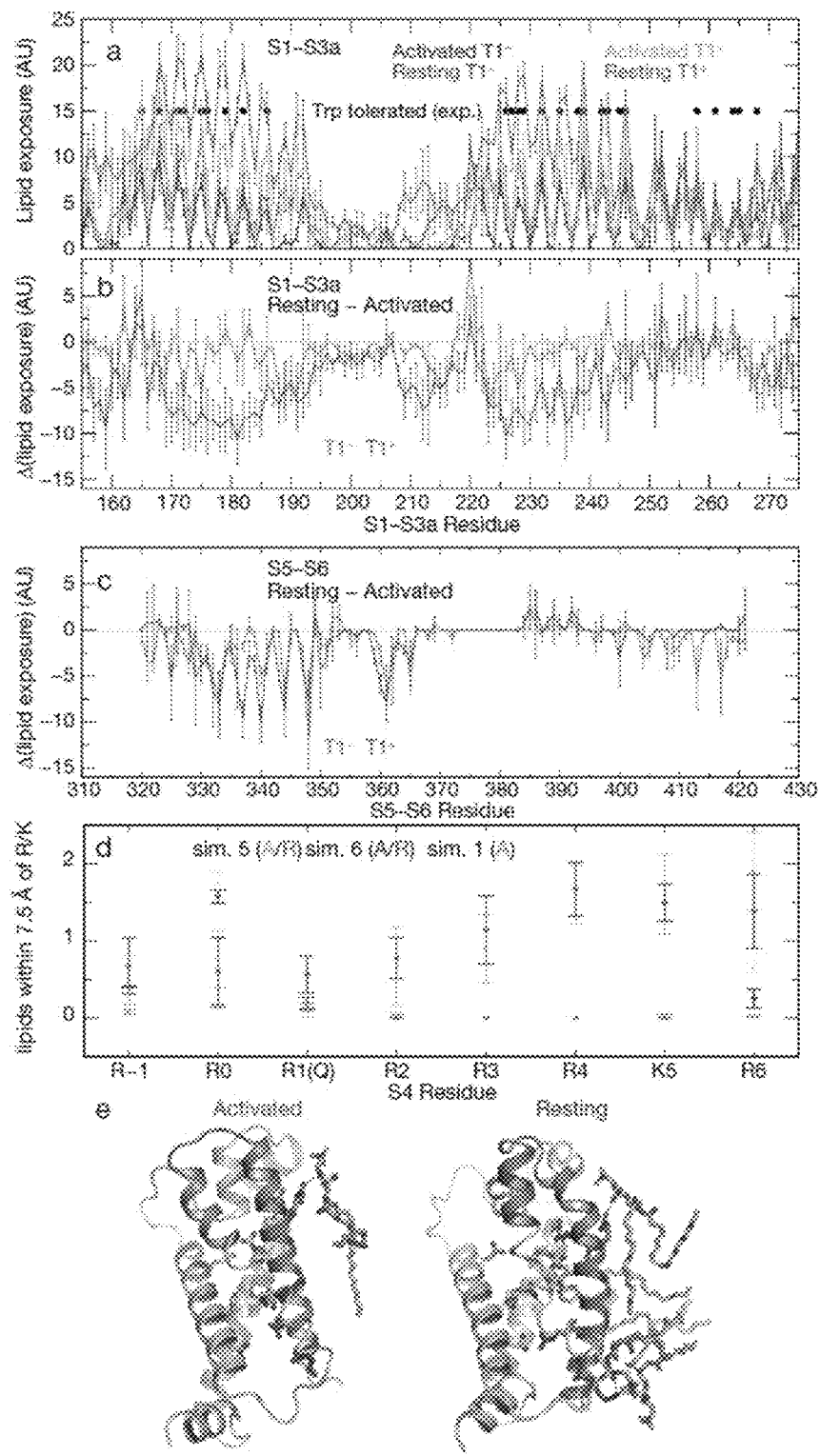
Figures 25A-E

>001 homo_hvcn1 gi_91992153_ (SEQ ID NO: 74)

RKLFSSHRFQVIIICLVVLDALLVLAELILDLKIIQPDKNNYAAMVFHYMSITILVFFMMEIIFKLFVFRLEFFHHK
FEILDAVVVVSFILDIVLLFQEHQFEALGLLILLRLWRVARIINGIIISVKTRSERQLLRLKQ

>002 gallus_hvcn gi_71897219_ (SEQ ID NO: 75)

KKLFSSRRFQIVIVFLVIVDALLVLGELLMDLKIIHPDKYHIAPKVFHYLSLSILTIFLVEVGFKIFVYGREFFHHK
FEVLDSIVVVVSFILDLVLLFREHEFEAVGLLILLRLWRVARIINGIILSVKTRSEQQVSKLKQ

>003 opossum_hvcn gi_12632423_(SEQ ID NO: 76)

RKLFGSHRFQVIIICLVIMDALLVLAELMLDLKIIQPDKDNYAARVFHYLSIAILTFFMIEVALKLYVFRLEFFYHK
FEILDAVIVIISFVLDIVLLFQEHAFEALGLLILLRLWRVARIINGIIISVKTRSERQLSRLKL

>004 rat_hvcn1 _gi_109497399_(SEQ ID NO: 77)

RKLFSSHRFQVIIICLVVLDALLVLAELLLDLRIIEPDLSKYSTKVFHYLSLAILAFFVLEISLKVFVFRLEFFHHK
FEILDAIVVVVSFVLDLILLFKNHHFEALGLLILLRLWRVARIINGIIISVKTRSERQILRLKQ

>005 equus_hvcn1 gi_194214323_(SEQ ID NO: 78)

RKLFSCHRFQVIIICLVILDALLVLAELILDLKIIEADKNNYVPRVFHYMSLAILTFFMTEVSLKIFVFRLEFFHHK
FEILDAVVVVSFVLDIVLIFREHEFEALGLLILLRLWRVARIINGIIISVKTRSERQLLRLKQ

>006 bos_hvcn1 gi_119909285_(SEQ ID NO: 79)

RKLFSAHRFQVIIICLVVLDALLVLAELVLDLKIIEPDKNNYAPKVFHYMSLAILTFFMMEIFFKIFVFRLEFFHHK
FEILDTIVVVISFILDLVLLFREHQFEALGLLILLRLWRVARIINGIIISVKTRSERQLLRLKQ

>007 sus_hvcn1 gi_194042948_(SEQ ID NO: 80)

RKLFSAHRFQVIIICLVILDALLVLAELVLDLKIIQPDKNNYANRVFHYMSVAILTFFMMEIFFKIFVFRFEFFHHK
FEILDAIVVVSFILDVVLLFREHEFEALGLLILLRLWRVARIINGIIISVKTRSERQLLRLKQ

Figure 29A

>008 macaca_hvcn_4 gi_109098724_ (SEQ ID NO: 81)

RKLFSSHRFQVIIICLVVLDTLLVLAELILDLRIIQPDKKNYAAMIFHYMSIAILALFMMEITFKLFVFRLEFFHHK
FEILDAVVVVSFVLDVVLLFQEHEFEALGLLILLRLWRVARIINGIIISVKTRSERQLLRLKQ

>009 macaca_hvcn gi_109098722_ (SEQ ID NO: 82)

RKLFSSHRFQVIIICLVVLDTLLVLAELILDLRIIQPDKKNYAAMIFHYMSIAILALFMMEITFKLFVFRLEFFHHK
FEILDAVVVVSFVLDVVLLFQEHEFEALGLLILLRLWRVARIINGIIISVKTRSERQLLRLKQ

>010 macaca_hvcn_2 gi_10909872_ (SEQ ID NO: 83)

EVIIICLVVLDTLLVLAELILDLRIIQPDKKNYAAMIFHYMSIAILALFMMEITFKLFVFRLEFFHHKFEILDAVVV
VVSFVLDVVLLFQEHEFEALGLLILLRLWRVARIINGIIISVKTRSERQLLRLKQ

>011 dog_hvcn1_2 gi_73994604_ (SEQ ID NO: 84)

RKLFSSHRFQVIIICLVILDALLVLAELILDLKIIQGDKNNYATKVFHYSSFAILTLFMMEVFLKLFVFRLEFFHHK
FEILDTFVVVVSFILDLVLLFQKHEFEALGLLILLRLWRVARIINGIIISVKTRSERQLLRLKQ

>012 dog_hvcn1 gi_73994606_ (SEQ ID NO: 85)

RKLFSSHRFQVIIICLVILDALLVLAELILDLKIIQGDKNNYATKVFHYSSFAILTLFMMEVFLKLFVFRLEFFHHK
FEILDTFVVVVSFILDLVLLFQKHEFEALGLLILLRLWRVARIINGIIISVKTRSERQLLRLKQ

>013 mus_hvcn1 gi_109809757_ (SEQ ID NO: 86)

RKLFSSHRFQVIIICLVVLDALLVLAELLLDLKIIEPDEQDYAVTAFHYMSFAILVFFMLEIFFKIFVFRLEFFHHK
FEILDAFVVVVSFVLDLVLLFKSHHFEALGLLILLRLWRVARIINGIIISVKTRSERQILRLKQ

>014 xenopus_t_hvcn1 gi_58332220_ (SEQ ID NO: 87)

KWLFSSHKFQIVIICLVILDALFVLVEVLLDLELLAEKVDHIIPEIFHYLSISVLSFFILEIAGKLYAFRLEFFHHK
FEVFDAAIVVISFIIDIVYISREDIFNAVGLLILLRLWRVARIVNGIIVSVKTQAEDKIHRLKE

Figure 29B

>015 xenopus_l_hvcn1 gi_148235789_148235(SEQ ID NO: 88)

KWLLSSHKFQIVIICLVILDALFVLVEVLLDLELLAEKVDHIIPEIFHYLSISVLTFFILEIAGKLYAFRLEFFHHK
FEVFDAAIVVISFIIDIVYISREDIFNAVGLLILLRLWRVARIVNGVIVSVKTRAEEKMHKLKE

>016 danio_hvcn1 gi_50539752_(SEQ ID NO: 89)

RKLYSTERFQIVVVCLVVLDAIFVLCELLIDLSIIEADHHRIAPQVFHYLSLALLTFFMVELAGKIFAYRLEFLHHK
FEVFDGIVVVVSFILDIIYISKEDAFDAMGLLILLRLWRVARIINGILVSVQNRANHRVEKLKE

>017 tetraodon_hvcn1 gi_47209646_(SEQ ID NO: 90)

KQMYCSERFQILVVCLVILDAIFVLVELLLDLSIIKLDHGSVAPEVFHFLSLGLVVFFLLELAGKLFAFRKEFFDHK
FEVFDGLVVTVSFVLDVAFIFHEDAFDGIGLLILLRLWRVARIINGILVSVKTREQQKLHKLKE

>018 takifugu_hvcn1 ENSEMBL UPI00016E3E8E(SEQ ID NO: 91)

KWLYCSDRFQVLVVCLVILDAIFVLVELLLDLSIIKLDHGNVIPEVFHYLSLALVTFFVVELVGKLFAFRKEFFDHK
FEVFDGLVVVVSFVLDVAFIFREDAFDGIGLLILLRLWRVARIINGILVSVKTREQQKLHKLKE

>019 nematostella_hvcn gi_156364735_(SEQ ID NO: 92)

CEIIHGQKAQYTIIALVIIDCIIVIAELLVDLEILKVHHDNPAPHILHDVSIAILSLFIIELIVKIYAMGMEFFHHK
LEVFDGIVVIVSFALDIAFSGGNAAEGASLLIILRLWRVTRIVNGIILSVKMQDEKKIHHLHK

>020 ciona_hvcn _gi_118344228_(SEQ ID NO: 93)

RHILHSKPIHVAIIVLVVLDSFLVVGELLIDLKVIIVPHGNPAPEILHGFSLSILSIFMVEIALKIIADHRHFIHHK
VEVLDAVVVISFGVDIALIFVGESEALAAIGLLVILRLWRVFRIINGIIVTVKTKADDRVHEIKK

>021 trichoplex_hvcn1 gi_196002893_(SEQ ID NO: 94)

RQLIYSHKVHIAIVVLVILDALIVIAELLIDLSVIKVHHTSPLARAFHFTSIAILAIFLVEIVLKLYASDLAFFLHY
FEVFDALIVIVSFVLDIAYSNSEALSGVGLLVVLRLWRIARIVNGIISSVKSQANDKIHHL

Figure 29C

>022 human_CACNA1E_repeat_3 gi_53832005_(SEQ ID NO: 95)

HYIVNLRYFEMCILLVIAASSIALAAEDPVLTNSERNKVLRYFDYVFTGVFTFEMVIKMIDQGLILQDGSYFRDLWN
ILDFVVVVGALVAFALANALGTNKGRDIKTIKSLRVLRVLRPLKTIKRLPKLKAVFDCVVTSLKN

>023 drosophila_CAC1A_repeat_3 gi _24641459_(SEQ ID NO: 96)

HWVVNLPYFDFFIMVVISMSSIALAAEDPVRENSRRNKILNYFDYAFTGVFTIEMLLKIVDLGVILHPGSYLREFWN
IMDAVVVICAAVSFGFDMSGSSAGQNLSTIKSLRVLRVLRPLKTIKRVPKLKAVFDCVVNSLKN

>024 mouse_CAC1H_repeat_1 gi_254826786_(SEQ ID NO: 97)

LRLVCNPWFEHISMLVIMLNCVTLGMFRPCEDVECRSERCSILEAFDDFIFAFFAVEMVIKMVALGLFGQKCYLGDT
WNRLDFFIVMAGMMEYSLDGHNVSLSAIRTVRVLRPLRAINRVPSMRILVTLLLDTLPM

>025 homo_CAC1I_repeat_1 gi_51093859_(SEQ ID NO: 98)

IKMVCNPWFECVSMLVILLNCVTLGMYQPCDDMDCLSDRCKILQVFDDFIFIFFAMEMVLKMVALGIFGKKCYLGDT
WNRLDFFIVMAGMVEYSLDLQNINLSAIRTVRVLRPLKAINRVPSMRILVNLLLDTLPM

>026 homo_CAC1G_repeat3 sp_O43497(SEQ ID NO: 99)

HRIITHKMFDHVVLVIIFLNCITIAMERPKIDPHSAERIFLTLSNYIFTAVFLAEMTVKVVALGWCFGEQAYLRSSW
NVLDGLLVLISVIDILVSMVSDSGTKILGMLRVLRLLRTLRPLRVISRAQGLKLVVETLMSSLKP

>027 gallus_SCN1A_repeat1 uniprot_E1C4S3(SEQ ID NO: 100)

IKILVHSLFSMLIMCTILTNCVFMTMSNPPDWTKNVEYTFTGIYTFESLIKILARGFCLEDFTFLRDPWNWLDFTVI
TFAYVTEFVNLGNVSALRTFRVLRALKTISVIPGLKTIVGALIQSVKK

>028 rat_SCN2A_repeat1 sp_P04775(SEQ ID NO: 101)

IKILVHSLFNVLIMCTILTNCVFMTMSNPPDWTKNVEYTFTGIYTFESLIKILARGFCLEDFTFLRNPWNWLDFTVI
TFAYVTEFVNLGNVSALRTFRVLRALKTISVIPGLKTIVGALIQSVKK

Figure 29D

>029 mouse_SCN1A_repeat1 uniprot_A2APX8(SEQ ID NO: 102)

IKILVHSLFSMLIMCTILTNCVFMTMSNPPDWTKNVEYTFTGIYTFESLIKILARGFCLEDFTFLRDPWNWLDFTVI
TFAYVTEFVDLGNVSALRTFRVLRALKTISVIPGLKTIVGALIQSVKK

>030 mouse_SCN1A_repeat1 uniprot_A2APX7(SEQ ID NO: 103)

IKILVHSLFNVLIMCTILTNCVFMTMSNPPDWTKNVEYTFTGIYTFESLIKILARGFCLEDFTFLRDPWNWLDFTVI
TFAYVTEFVNLGNVSALRTFRVLRALKTISVIPGLKTIVGALIQSVKK

>031 rat_SCN11A_repeat1 sp_O88457(SEQ ID NO: 104)

IRISVHSVFSMFIICTVIINCMFMANSMERSFDNDIPEYVFIGIYILEAVIKILARGFIVDEFSFLRDPWNWLDFIV
IGTAIATCFPGSQVNLSALRTFRVFRALKAISVISGLKVIVGALLRSVKK

>032 mouse_SCN11A_repeat1 sp_Q9R053(SEQ ID NO: 105)

IRISVHSVFSMFIICTVIINCMFMANNSSVDSRPSSNIPEYVFIGIYVLEAVIKILARGFIVDEFSYLRDPWNWLDF
IVIGTAIAPCFLGNKVNNLSTLRTFRVLRALKAISVISGLKVIVGALLRSVKK

>033 homo_SCN11A_repeat1 sp_Q9UI33(SEQ ID NO: 106)

IRVSVHSLFSMFIIGTVIINCVFMATGPAKNSNSNNTDIAECVFTGIYIFEALIKILARGFILDEFSFLRDPWNWLD
SIVIGIAIVSYIPGITIKLLPLRTFRVFRALKAISVVSRLKVIVGALLRSVKK

>034 taeniopygia_SCN_repeat1 gi_224044620_(SEQ ID NO: 107)

IKILVHSLFSMFIMCTILTNCVFMAQSETPSWNKYVEYTFTGIYTFESLIKILARGFCMTEFTFLRDPWNWLDFSVI
VMAYITEFVDLGNVSALRTFRVLRALKTISVISGLKTIVGALIQSVKK

>035 homo_SCN4A_repeat1 sp_P35499(SEQ ID NO: 199)

IKVLIHALFSMFIMITILTNCVFMTMSDPPPWSKNVEYTFTGIYTFESLIKILARGFCVDDFTFLRDPWNWLDFSVI
MMAYLTEFVDLGNISALRTFRVLRALKTITVIPGLKTIVGALIQSVKK

Figure 29E

>036 rat_SCN5A_repeat1 sp_P15389(SEQ ID NO: 108)

VKILVHSLFSMLIMCTILTNCVFMAQHDPPPWTKYVEYTFTAIYTFESLVKILARGFCLHAFTFLRDPWNWLDFSVI
VMAYTTEFVDLGNVSALRTFRVLRALKTISVISGLKTIVGALIQSVKK

>037 rat_SCN9A_repeat1 sp_O08562(SEQ ID NO: 109)

IKILVHSLFSMLIMCTILTNCIFMTLSNPPEWTKNVEYTFTGIYTFESLIKILARGFCVGEFTFLRDPWNWLDFVVI
VFAYLTEFVNLGNVSALRTFRVLRALKTISVIPGLKTIVGALIQSVKK

>038 rabbit_SCN9A_repeat1 sp_Q28644(SEQ ID NO: 110)

IKILVHSLFSMLIMCTILTNCIFMTMNNPAEWTKNVEYTFTGIYTFESLVKIFARGFCVGEFTFLRDPWNWLDFIVI
VFAYLTEFVNLGNVSALRTFRVLRALKTISVIPGLKTIVGALIQSVKK

>039 homo_SNC3A_repeat1 sp_Q9NY46(SEQ ID NO: 111)

IKILVHSLFSMLIMCTILTNCVFMTLSNPPDWTKNVEYTFTGIYTFESLIKILARGFCLEDFTFLRDPWNWLDFSVI
VMAYVTEFVSLGNVSALRTFRVLRALKTISVIPGLKTIVGALIQSVKK

>040 canis_SCN_repeat1 gi_74004456_(SEQ ID NO: 112)

IKILVHSLFNVLIMCTILTNCVFMTMSNPPDWTKNVEYTFTGIYTFESLIKILARGFCLEDFTFLRDPWNWLDFTVI
TFAYVTEFVDLGNVSALRTFRVLRALKTISVIPGLKTIVGA

>041 danio_SCN8AA_repeat1 sp_Q9DF53(SEQ ID NO: 113)

IKILIHSVFSMFIMCTILTNCVFMTFSNPPEWSKQVEYTFTGIYTFESAVKIIARGFCIDGFTFLRDPWNWLDFMVI
SMAYVTEFVDLGNVSALRTFRVLRALKTISVIPGLKTIVGALIQSVKK

>042 mouse_SCN8A_repeat1 sp_Q9WTU3(SEQ ID NO: 114)

IKILIHSVFSMIIMCTILTNCVFMTFSNPPEWSKNVEYTFTGIYTFESLVKIIARGFCIDGFTFLRDPWNWLDFSVI
MMAYVTEFVDLGNVSALRTFRVLRALKTISVIPGLKTIVGALIQSVKK

Figure 29F

>043 canis_SCNAA_repeat1 sp_O46669(SEQ ID NO: 115)

IKVSVHSWFSLFITVTILVNCVGMTQTELPDRIEYVFTVIYTFEALIKILARGFCLNEFAYLRDPWDWLDFSVITLA
YIGEATALRGISGLRTFRVLRALKTVSVIPGLKVIVGALIHSVRK

>044 homo_SCN7A_repeat1 sp_Q01118(SEQ ID NO: 116)

IKVLVHPFFQLFILISVLIDCVFMSLTNLPKWRPVLENTLLGIYTFEILVKLFARGVWAGSFSFLGDPWNWLDFSVT
VFEVIIRYSPLDFIPTLQTARTLRILKIIPLNQGLKSLVGVLIHCLKQ

>045 rabbit_CAC1C_repeat1 sp_P15381(SEQ ID NO: 117)

ISIVEWKPFEIIILLTIFANCVALAIYIPFPEDDSNATNSNLERVEYLFLIIFTVEAFLKVIAYGLLFHPNAYLRNG
WNLLDFIIVVVGLFSAILEQATKADGANALGGKGAGFDVKALRAFRVLRPLRLVSGVPSLQVVLNSIIKAMV

>046 mouse_CAC1S_repeat1 sp_Q02789(SEQ ID NO: 118)

ISIVEWKPFETIILLTIFANCVALAVYLPMPEDDNNTLNLGLEKLEYFFLIVFSIEAAMKIIAYGFLFHQDAYLRSG
WNVLDFIIVFLGVFTVILEQVNIIQTNTAPMSSKGAGLDVKALRAFRVLRPLRLVSGVPSLQVVLNSIFKAML

>047 mouse_CAC1F_repeat1 sp_Q9JIS7(SEQ ID NO: 119)

ISIVEWKPFDILILLTIFANCVALGVYIPFPEDDSNTANHNLEQVEYVFLVIFTVETVLKIVAYGLVLHPSAYIRNG
WNLLDFIIVVVGLFSVLLEQGPGRPGDAPHTGGKPGGFDVKALRAFRVLRPLRLVSGVPSLHIVVNSIMKALV

>048 gallus_CAC1D_repeat1 sp_O73700(SEQ ID NO: 120)

ISLVEWKPFDIFILLSIFANCVALAVYIPFPEDDSNSTNHNLEKVEYAFLIIFTVETFLKIIAYGLLHPNAYVRNG
WNLLDFVIVVVGLFSVILEQLTKETEGGSHSGGKPGGFDVKALRAFRVLRPLRLVSGVPSLQVVLNSIIKAMV

>049 homo_CACN_repeat1 gi_193788728_(SEQ ID NO: 121)

ISIVEWKPFEIIILLTIFANCVALAIYIPFPEDDSNATNSNLERVEYLFLIIFTVEAFLKVIAYGLLFHPNAYLRNG
WNLLDFIIVVVGLFSAILEQATKADGANALGGKGAGFDVKALRAFRVLRPLRLVSGVPSLQVVLNSIIKAMVP

Figure 29G

>050 drosophila_CAC1D_repeat1 sp_Q24270(SEQ ID NO: 122)

IRIVEWKPFEFLILLTIFANCIALAVYTPYPGSDSNVTNQTLEKVEYVFLVIFTAECVMKILAYGFVLHNGAYLRNG
WNLLDFTIVVIGAISTALSQLMKDAFDVKALRAFRVLRPLRLVSGVPSLQVVLNSILKAMV

>051 homo_CAC1A_repeat1 sp_O00555(SEQ ID NO: 123)

KKITEWPPFEYMILATIIANCIVLALEQHLPDDDKTPMSERLDDTEPYFIGIFCFEAGIKIIALGFAFHKGSYLRNG
WNVMDFVVVLTGILATVGTEFDLRTLRAVRVLRPLKLVSGIPSLQVVLKSIMKAMIP

>052 homo_CAC1B_repeat1 sp_Q00975(SEQ ID NO: 124)

KRITEWPPFEYMILATIIANCIVLALEQHLPDGDKTPMSERLDDTEPYFIGIFCFEAGIKIIALGFVFHKGSYLRNG
WNVMDFVVVLTGILATAGTDFDLRTLRAVRVLRPLKLVSGIPSLQVVLKSIMKAMV

>053 rat_SCN11A_repeat3 sp_O88457(SEQ ID NO: 125)

YQIVKHSWFESFIIFVILLSSGALIFEDVNLPSRPQVEKLLRCTDNIFTFIFLLEMILKWVAFGFRRYFTSAWCWLD
FLIVVVSVLSLMNLPSLKSFRTLRALRPLRALSQFEGMKVVVYALISAIPA

>054 mouse_SCN11A_repeat3 sp_Q9R053(SEQ ID NO: 126)

YQIVKHSWFESFIIFVILLSSGALIFEDVNLPSRPQVEKLLKCTDNIFTFIFLLEMILKWVAFGFRKYFTSAWCWLD
FLIVVVSGLSLTNLPNLKSFRNLRALRPLRALSQFEGMKVVVNALMSAIPA

>055 rat_SCN9A_repeat3 sp_O08562(SEQ ID NO: 127)

YRIVEHSWFESFIVLMILLSSGALAFEDIYIEKKKTIKIILEYADKIFTYIFILEMLLKWVAYGYKTYFTNAWCWLD
FLIVDVSLVTLVANTLGYSDLGPIKSLRTLRALRPLRALSRFEGMRVVVNALIGAIPS

>056 rabbit_SCN9A_repeat3 sp_Q28644(SEQ ID NO: 128)

YRIVEHSWFESFIVLMILLSSGALAFEDIYIEKKKTIKIILEYADKIFTYIFILEMLLKWVAYGYKTYFTNAWCWLD
FLIVDVSLVTLVANTLGYSDLGPIKSLRTLRALRPLRALSRFEGMRVVVNALIGAIPS

Figure 29H

>057 mouse_SCN9A_repeat3 uniprot_B7ZWN(SEQ ID NO: 129)

YRIVEHSWFESFIVLMILLSSGALAFEDIYIEKKKTIKIILEYADKIFTYIFILEMLLKWVAYGYKTYFTNAWCWLD
FLIVDVSLVTLVANTLGYSDLGPIKSLRTLRALRPLPALSRFEGMRVVVNALIGAIPS

>058 mouse_KCNH1 sp_Q60603(SEQ ID NO: 130)

TWDWIILILTFYTAILVPYNVSFKTRQNNVAWLVVDSIVDVIFLVDIVLNFHTTFVGPAGEVISDPKLIRMNYLKTW
FVIDLLSCLPYDVINAFENVDEVSAFMGDPGKIGFADQIPPPLEGRESQGISSLFSSLKVVRLLRLGRVARKLDHYI
EYGAAVLV

>059 mouse_KCNH8 sp_P59111(SEQ ID NO: 131)

GWDWLILLATFYVAVTVPYNVCFIGNEDLSTTRSTTVSDIAVEILFIIDIILNFRTTYVSKSGQVIFEARSICIHYV
TTWFIIDLIAALPFDLLYAFNVTVVSLVHLLKTVRLLRLLRLLQKLDRYSQHSTIVLTLLMSM

>060 homo_KCNH3 sp_Q9ULD8(SEQ ID NO: 132)

TWDGFILLATLYVAVTVPYSVCVSTAREPSAARGPPSVCDLAVEVLFILDIVLNFRTTFVSKSGQVVFAPKSICLHY
VTTWFLLDVIAALPFDLLHAFKVNVYFGAHLLKTVRLLRLLRLLPRLDRYSQYSAVVLT

>061 homo_CAC1G_repeat4 sp_O43497(SEQ ID NO: 133)

HHLCTSHYLDLFITGVIGLNVVTMAMEHYQQPQILDEALKICNYIFTVIFVLESVFKLVAFGFRRFFQDRWNQLDLA
IVLLSIMGITLEEIEVNASLPINPTIIRIMRVLRIARVLKLLKMAVGMRALLDTVMQALPQ

>062 mouse_SCN11A_repeat4 sp_Q9R053(SEQ ID NO: 134)

FDLVTSQVFDVIILGLIVTNMIIMMAESEGQPNEVKKIFDILNIVFVVIFTVECLIKVFALRQHYFTNGWNLFDCVV
VVLSIISTLVSGLENSNVFPPTLFRIVRLARIGRILRLVRAARGIRTLLFALMMSLPS

>063 rat_SCN9A_repeat4 sp_O08562(SEQ ID NO: 135)

FDLVTNQAFDITIMVLICLNMVTMMVEKEGQTEYMDYVLHWINMVFIILFTGECVLKLISLRHYYFTVGWNIFDFVV
VILSIVGMFLAEMIEKYFVSPTLFRVIRLARIGRILRLIKGAKGIRTLLFALMMSLPA

>064 rat_SCN11A_repeat4 sp_O88457(SEQ ID NO: 136)

FDLVTSQVFDVIILGLIVLNMIIMMAESADQPKDVKKTFDILNIAFVVIFTIECLIKVFALRQHYFTNGWNLFDCVV
VVLSIISTLVSRLEDSDISFPPTLFRVVRLARIGRILRLVRAARGIRTLLFALMMSLPS

>065 homo_CAC1G_repeat2 sp_O43497(SEQ ID NO: 137)

RKIVDSKYFGRGIMIAILVNTLSMGIEYHEQPEELTNALEISNIVFTSLFALEMLLKLLVYGPFGYIKNPYNIFDGV
IVVISVWEIVGQQGGGLSVLRTFRLMRVLKLVRFLPALQRQLVVLMKTMDN

>066 homo_CACNA1E_repeat_4 sp_Q15878(SEQ ID NO: 138)

WHFVVSPSFEYTIMAMIALNTVVLMMKYYSAPCTYELALKYLNIAFTMVFSLECVLKVIAFGFLNYFRDTWNIFDFI
TVIGSITEIILTDSKLVNTSGFNMSFLKLFRAARLIKLLRQGYTIRILLWTFVQSFKA

>067 drosophila_CAC1A_repeat_4 sp_P91645(SEQ ID NO: 139)

WRIVVSTPFEYFIMMLIVFNTLLLMMKYHNQGDMYEKSLKYINMGFTGMFSVETVLKIIGFGVKNFFKDPWNIFDLI
TVLGSIVDALWMEFGHDDSNSINVGFLRLFRAARLIKLLRQGYTIRILLWT

>068 homo_KCNV2 sp_Q8TDN2(SEQ ID NO: 140)

WNLMEKPFSSVAAKAIGVASSTFVLVSVVALALNTVEEMQQHSGQGEGGPDLRPILEHVEMLCMGFFTLEYLLRLAS
TPDLRRFARSALNLVDLVAILPLYLQLLLECFTGEGHQRGQTVGSVGKVGQVLRVMRLMRIFRILKLARHSTGLRAF
GFTLRQCYQQ

>069 homo_KCNF1 sp_Q9H3M0_KCNF1(SEQ ID NO: 141)

WKFLEKPESSCPARVVAVLSFLLILVSSVVMCMGTIPELQVLDAEGNRVEHPTLENVETACIGWFTLEYLLRLFSSP
NKLHFALSFMNIVDVLAILPFYVSLTLTHLGARMMELTNVQQAVQALRIMRIARIFKLARHSSGLQTLTYALKRSFK
E

>070 homo_KCNB1 sp_Q14721(SEQ ID NO: 142)

WDLLEKPNSSVAAKILAIISIMFIVLSTIALSLNTLPELQSLDEFGQSTDNPQLAHVEAVCIAWFTMEYLLRFLSSP
KKWKFFKGPLNAIDLLAILPYYVTIFLTESNKSVLQFQNVRRVVQIFRIMRILRILKLARHSTGLQSLGFTLRRSYN
E

Figure 29J

>071 canis_KCNB2 sp_Q95167(SEQ ID NO: 143)

RDLLEKPNSSVAAKILAIVSNLFIVLSTIALSLNTLPELQEMDEFGQPNDNPQLAHVEAVCNAWFTMEYLLRFLSSP
NKWKFFKGPLNVIDLLAILPYYVTIFLTESNKSVLQFQNVRRVVQIFRIMRILRILKLARHSTGLQSLGFTLRRSYN
E

>072 drosophila_KCNAB sp_P17970(SEQ ID NO: 144)

WELLEKPNTSFAARVIAVISILFIVLSTIALTLNTLFQLQHIDNGTPQDNPQLAMVEAVCITWFTLEYILRFSASPD
KWKFFKGGLNIIDLLAILPYFVSLFLLETNKNATDQFQDVRRVVQVFRIMRILRVLKLARHSTGLQSLGFTLRNSYK
E

>073 pongo_KCNV1 sp_Q5RC10(SEQ ID NO: 145)

WNILEKPGSSTAARIFGVISIIFVVVSIINMALMSAELSWLDLQLLEILEYVCISWFTGEFVLRFLCVRDRCRFLRK
VPNIIDLLAILPFYITLLVESLSGSQTTQELENVGRIVQVLRLLRALRMLKLGRHSTGLRSLGMTITQCYEE

>074 homo_KCNS3 sp_Q9BQ31(SEQ ID NO: 146)

WIRMENPAYCLSAKLIAISSLSVVLASIVAMCVHSMSEFQNEDGEVDDPVLEGVEIACIAWFTGELAVRLAAAPCQK
KFWKNPLNIIDFVSIIPFYATLAVDTKEEESEDIENMGKVVQILRLMRIFRILKLARHSVGLRSLGATLRHSYHE

>075 squirrelmonkey_KCNS1 sp_A4K2X4(SEQ ID NO: 147)

WLTMENPGYSLPSKLFSCVSISVVLASIAAMCIHSLPEYQAREAAAVAAVAAGRSAEGVRDDPVLRRLEYFCIAWF
SFEVSSRLLLAPSTRNFFCHPLNLIDIVSVLPFYLTLLAGAALGDQGGTGGKEFGHLGKVVQVFRLMRIFRVLKLAR
HSTGLRSLGATLKHSYRE

>076 gallus_KCNG2 sp_O73606(SEQ ID NO: 148)

RDMVENPHSGIPGKIFACISISFVAITAVSLCISTMPDVREEEDRGECSQKCYDIFVLETVCVAWFSFEFLLRSIQA
ENKCAFLKTPLNIIDILAILPFYISLIVDMASTKNSSKPGGGAGNKYLERVGLVLRFLRALRILYVMRLARHSLGLQ
TLGLTVRRCTRE

Figure 29K

>077 homo_KCNG4 sp_Q8TDN1(SEQ ID NO: 149)

REMVENPQSGLPGKVFACLSILFVATTAVSLCVSTMPDLRAEEDQGECSRKCYYIFIVETICVAWFSLEFCLRFVQA
QDKCQFFQGPLNIIDILAISPYYVSLAVSEEPPEDGERPSGSSYLEKVGLVLRVLRALRILYVMRLARHSLGLQTLG
LTVRRCTRE

>078 rat_KCNC3 sp_Q01956_KCNC3(SEQ ID NO: 150)

WALFEDPYSSRAARYVAFASLFFILSITTFCLETHEGFIHISNKTVTQASPIPGAPPENITNVEVETEPFLTYVEG
VCVVWFTFEFLMRVTFCPDKVEFLKSSLNIIDCVAILPFYLEVGLSGLSSKAAKDVLGFLRVVRFVRILRIFKLTRH
FVGLRVLGHTLRASTNE

>079 homo_KCNC2 sp_Q96PR1(SEQ ID NO: 151)

WALFEDPYSSRAARFIAFASLFFILVSITTFCLETHEAFNIVKNKTEPVINGTSVVLQYEIETDPALTYVEGVCVVW
FTFEFLVRIVFSPNKLEFIKNLLNIIDFVAILPFYLEVGLSGLSSKAAKDVLGFLRVVRFVRILRIFKLTRHFVGLR
VLGHTLRASTNE

>080 drosophila_KCNAW sp_P17972(SEQ ID NO: 152)

WSLFDEPYSSNAAKTIGVVSVFFICISILSFCLKTHPDMRVPIVRNITVKTANGSNGWFLDKTQTNAHIAFFYIECV
CNAWFTFEILVRFISSPNKWEFIKSSVNIIDYIATLSFYIDLVLQRFASHLENADILEFFSIIRIMRLFKLTRHSSG
LKILIQTFRASAKE

>081 homo_KCNA1 sp_Q09470(SEQ ID NO: 153)

WLLFEYPESSGPARVIAIVSVMVILISIVIFCLETLPELKDDKDFTGTVHRIDNTTVIYNSNIFTDPFFIVETLCII
WFSFELVVRFFACPSKTDFFKNIMNFIDIVAIIPYFITLGTEIAEQEGNQKGEQATSLAILRVIRLVRVFRIFKLSR
HSKGLQILGQTLKASMRE

>082 rat_KNCA6 sp_P17659(SEQ ID NO: 154)

WLLFEYPESSGPARGIAIVSVLVILISIVIFCLETLPQFRADGRGGSNEGSGTRMSPASRGSHEEEDEDEDSYAFPG
SIPSGGLGTGGTSSFSTLGGSFFTDPFFLVETLCIVWFTFELLVRFSACPSKAAFFRNIMNIIDLVAIFPYFITLGT
ELVQRHEQQPVSGGSGQNRQQAMSLAILRVIRLVRVFRIFKLSRHSKGLQILGKTLQASMRE

Figure 29L

>083 homo_KCNA5 sp_P22460(SEQ ID NO: 155)

WLIFEYPESSGSARAIAIVSVLVILISIITFCLETLPEFRDERELLRHPPAPHQPPAPAPGANGSGVMAPPSGPTVA
PLLPRTLADPFFIVETTCVIWFTFELLVRFFACPSKAGFSRNIMNIIDVVAIFPYFITLGTELAEQQPGGGGGQNG
QQAMSLAILRVIRLVRVFRIFKLSRHSKGLQILGKTLQASMRE

>084 rat_KCNA3 sp_P15384(SEQ ID NO: 156)

WLLFEYPESSGPARGIAIVSVLVILISIVIFCLETLPEFRDEKDYPASPSQDVFEAANNSTSGASSGASSFSDPFFV
VETLCIIWFSFELLVRFFACPSKATFSRNIMNLIDIVAIIPYFITLGTELAERQGNGQQAMSLAILRVIRLVRVFRI
FKLSRHSKGLQILGQTLKASMRE

>085 canis_Kv1.3 gi_57088651_(SEQ ID NO: 157)

WLLFEYPESSGPARGIAIVSVLVILVSIVIFCLETLPEFRDDKDYAAAAQEQPEAARNGTSGPPAAAGFADPFFVVE
TLCIIWFSFELLVRFFACPSKATFSRNIMNLIDIVAIIPYFITLGTELAERQGNGQQAMSLAILRVIRLVRVFRIFK
LSRHSKGLQILGQTLKASMRE

>086 bovine_KCNA4 sp_Q05037(SEQ ID NO: 158)

WLLFEYPESSSPARGIAIVSVLVILISIVIFCLETLPEFRDDRDLIMALSTGGHGGLLNDTSAPHPENSGHTIFNDP
FFIVETVCIVWFSFEFVVRCFACPSQALFFKNIMNIIDIVSILPYFITLGTDLAQQQGGGNGQQQQAMSFAILRIIR
LVRVFRIFKLSRHSKGLQILGHTLRASMRE

>087 homo_KCA10 sp_Q16322(SEQ ID NO: 159)

WLLFEYPESSSAARAVAVVSVLVVVISITIFCLETLPEFREDRELKVVRDPNLNMSKTVLSQTMFTDPFFMVESTCI
VWFTFELVLRFVVCPSKTDFFRNIMNIIDIISIIPYFATLITELVQETEPSAQQNMSLAILRIIRLVRVFRIFKLSR
HSKGLQILGQTLKASMRE

>088 rat_Kv1.2 2R9R_b_vs gi_16087779_(SEQ ID NO: 160)

WLLFEYPESSGPARIIAIVSVMVILISIVSFCLETLPIFRDENEDMHGGGVTFHTYSQSTIGYQQSTSFTDPFFIVE
TLCIIWFSFEFLVRFFACPSKAGFFTNIMNIIDIVAIIPYYVTIFLTESNKSVLQFQNVRRVVQIFRIMRILRIFKL
SRHSKGLQ

Figure 29M

>089 homo_Kv gi_4826782_(SEQ ID NO: 161)

WLLFEYPESSGPARIIAIVSVMVILISIVSFCLETLPIFRDENEDMHGSGVTFHTYSNSTIGYQQSTSFTDPFFIVE
TLCIIWFSFEFLVRFFACPSKAGFFTNIMNIIDIVAIIPYFITLGTELAEKPEDAQQGQQAMSLAILRVIRLVRVFR
IFKLSRHSKGLQILGQTLKASMRE

>090 rat_Kv pdb:2A79_chainb(SEQ ID NO: 162)

WLLFEYPESSGPARIIAIVSVMVILISIVSFCLETLPIFRDENEDMHGGGVTFHTYSNSTIGYQQSTSFTDPFFIVE
TLCIIWFSFEFLVRFFACPSKAGFFTNIMNIIDIVAIIPYFITLGTELAEKPEDAQQGQQAMSLAILRVIRLVRVFR
IFKLSRHSKGLQILGQTLKASMRE

>091 canis_KCNA2 sp_Q28293(SEQ ID NO: 163)

WLLFEYPESSGPARIIAIVSVMVILISIVSFCLETLPIFRDENEDMHGGGVTFHTYSNSTIGYQQSTSFTDPFFIVE
TLCIIWFSFEFLVRFFACPSKAGFFTNIMNIIDIVAIIPYFITLGTELAEKPEDAQQGQQAMSLAILRVIRLVRVFR
IFKLSRHSKGLQILGQTLKASMRE

>092 drosophila_shaker_Kchannel gi_288442_(SEQ ID NO: 164)

WLLFEYPESSQAARVVAIISVFVILLSIVIFCLETLPEFKHYKVFNTTTNGTKIEEDEVPDITDPFFLIETLCIIWF
TFELTVRFLACPNKLNFCRDVMNVIDIIAIIPYFITLATVVAEEEDTLNLPKAPVSPQDKSSNQAMSLAILRVIRLV
RVFRIFKLSRHSKGLQILGRTLKASMRE

>093 rabbit_KCND3 sp_Q9TTT5(SEQ ID NO: 165)

WRAFENPHTSTLALVFYYVTGFFIAVSVITNVVETVPCGTVPGSKELPCGERYSVAFFCLDTACVMIFTVEYLLRLF
AAPSRYRFIRSVMSIIDVVAIMPYYIGLVMTNNEDVSGAFVTLRVFRVFRIFKFSRHSQGLRILGYTLKSCASE

>094 hum_CACNA1E_repeat_2_sp_Q15878(SEQ ID NO: 166)

RHMVKSQVFYWIVLSLVALNTACVAIVHHNQPQWLTHLLYYAEFLFLGLFLLEMSLKMYGMGPRLYFHSSFNCFDFG
VTVGSIFEVVWAIFRPGTSFGISVLRALRLLRIFKITKYWASLRNLVVSLMSSMKS

>095 drosophila_CAC1A_repeat_2 sp_P91645(SEQ ID NO: 167)

RHTVKTQWFYWFVIVLVFLNTVCVAVEHYGQPSFLTEFLYYAEFIFLGLFMSEMFIKMYALGPRIYFESSFNRFDCV
VISGSIFEVIWSEVKGGSFGLSVLRALRLLRIFKVTKYWSSLRNLVISLLNSMRS

Figure 29N

>096 mouse_SCN11A_repeat2 sp_Q9R053(SEQ ID NO: 168)

QTIMTDPFTELAITICIIVNTVFLAMEHHNMDNSLKDILKIGNWVFTGIFIAEMCLKIIALDPYHYFRHGWNIFDSI
VALVSLADVLFHKLSKNLSFLASLRVLRVFKLAKSWPTLNTLIKIIGHSVGA

>097 rat_SCN11A_repeat2 sp_O88457(SEQ ID NO: 169)

RFIMTDPFTELAITICIIINTVFLAVEHHNMDDNLKTILKIGNWVFTGIFIAEMCLKIIALDPYHYFRHGWNVFDSI
VALLSLADVLYNTLSDNNRSFLASLRVLRVFKLAKSWPTLNTLIKIIGHSVGA

>098 rat_SCN9A_repeat2 sp_O08562(SEQ ID NO: 170)

YFIVMDPFVDLAITICIVLNTLFMAMEHHPMTEEFKNVLAVGNLIFTGIFAAEMVLKLIAMDPYEYFQVGWNIFDSL
IVTLSLIELFLADVEGLSVLRSFRLLRVFKLAKSWPTLNMLIKIIGNSVGA

>099 ornitho_C15orf27 _gi_149410687_(SEQ ID NO: 171)

WQVFLLSASLNSFLVACVILVVILLTLELLIDIKLLQFSSASQFASVVHWISLIILSVFFTETILRIVVLGIWDYIE
NKIEVFDGAVIILSLAPMVASTVANGPSSPWDAISLIITLRIWRVKRIIDAYVLPVKVEMEMVIQQYEKA

>100 danio_c15orf27 _gi_123703002_(SEQ ID NO: 172)

WQVCLLSAGFNCFLVACVILVVLLLTLELLIDTKLLQFNNAFQFACIIHWISLVILSVFFTETVFRIVVLGIWDYIE
NKVEVFDGAVIVLSLAPMVASTVANGPSSPWDAISLIITLRIWRVKRIIDAYVLQVKVEMELEIQQYEKS

>101 monodelphis_C15orf27 gi_12627230_(SEQ ID NO: 173)

WQVFLLSASLNSFLVACVILVVILLTLELLIDIKSLQFSNSSQFAGVSHWISLVILSVFFSETILRIVVLGIWDYIE
NKIEVFDGAVIILSLAPMVASTIANGPSSPWDAISLTIALRIWRVKRIIDAYVLPVKVELEMVIQQYEKA

>102 sus_C15orf27 gi_194039682_(SEQ ID NO: 174)

WQVFLLSASVNSFLVACVILVVILLTLELLIDIKLLQFSSAFQFAGVIHWISLVILSVFFSETVLRIVVLGIWDYIE
NKIEVFDGAVIILSLAPMVASTVANGPRSPWDAISLIIMLRIWRVKRVIDAYVLPVKVEMEMVIQQYEKA

Figure 29O

>103 homo_C15orf27_gi_118442841_(SEQ ID NO: 175)

WQVFLLSASLNSFLVACVILVVILLTLELLIDIKLLQFSSAFQFAGVIHWISLVILSVFFSETVLRIVVLGIWDYIE
NKIEVFDGAVIILSLAPMVASTVANGPRSPWDAISLIIMLRIWRVKRVIDAYVLPVKLEMEMVIQQYEKA

>104 pan_C15orf27_gi_114658268_(SEQ ID NO: 176)

WQVFLLSASLNSFLVACVILVVILLTLELLIDIKLLQFSSAFQFAGVIHWISLVILSVFFSETVLRIVVLGIWDYIE
NKIEVFDGAVIILSLAPMVASTVANGPRSPWDAISLIIMLRIWRVKRVIDAYVLPVKLEMEMVIQQYEKA

>105 horse_C15orf27_gi_149692210_(SEQ ID NO: 177)

WQVFLLSASLNSFLVACVILVVILLTLELLIDIKLLQFSSAFQFAGVIHWISLVILSVFFSETVLRIVVLGIWDYIE
NKIEVFDGAVIILSLAPMVASTVANGPRSPWDAISLIIMLRIWRVKRVIDAYVLPVKVEMEMVIQQYEKA

>106 mus_C15orf27 gi_27370422_(SEQ ID NO: 178)

WQVFLLSASLNSFLVACVILVVILLTLELLIDTKLLQFSNAFQFAGVIHWISLVILSVFFSETVLRIVVLGIWDYIE
NKIEVFDGAVIILSLAPMVASTVANGPRSPWDAISLIIMFRIWRVKRVIDAYVLPVKLEMEMVTQQYEKA

>107 rat_C15or27 gi_157817759_(SEQ ID NO: 179)

WQVLLLSASLNSFLVACVILVVILLTLELLIDIKLLQFSSAFQFAAVIHWISLVILSVFFSETILRIVVLGIWDYIE
NKIEVFDGAVIILSLAPMVASTVANGPRSPWDAISLIIMFRIWRVKRVIDAYVLPVKLEMEMVTQQYEKA

>108 ciona_C15orf gi_198433556_(SEQ ID NO: 180)

RKILHSVAFYIYILISTFIVTLLLLAELLIDVGVINIPSSPDTVVLNASALSTLKVQTPAQKTSTILHWISFSFLSL
FFIEIMFRLYAWKLNIIRSIVSVFDCSIVTMAIATNLAATLAAGSTSPFDAISLLIILRFIRIHSLIQRCVSDSKQE
IREKLTKTECS

>109 methanococcus_hyperpol_Kv sp_Q57603(SEQ ID NO: 181)

KKIMEVLSLIFTFEIVASFILSTYNPPYQDLLIKLDYISIMFFTFEFIYNFYYVEDKAKFFKDIYNIVDAIVVIAFL
LYSLQVFYSKAFLGLRVINLLRILVLLRIIKLRKLEENQALIN

Figure 29P

>110 ornitho_vsp gi_149635858_(SEQ ID NO: 182)

LTTKTEIFGVSLIFVDVALLIVILVTTSKSIRIPFAYRVVSLLIALFFLFDVLLRIFAEGFRNYFSIKLNILDAFIV
VGTLMIDIVYIYVNTGGVKQIPRLAILLRPLRIIILIRIFRLAVQKKQLEKVTRRMVSENKR

>111 xenopus_t_vsp _gi_62859843_(SEQ ID NO: 183)

SPFVMSFGFRVFGVVLIIVDFVLVIVDLSVSTQSSGASTAISSISLSISFFFLIDVLLHIFVEGFRQYFSSKLNIFD
AVIVIVTLLVTLVYAFTDFSGASNIPRMVNFLRALRIIILIRILRLASQKRQLEKVTRRLVSENKR

>112 gallus_vsp gi_118084924_(SEQ ID NO: 184)

SPFVMSFGFRVFGVVLIIVDIIVVIVDLAISEKKRGIREILEGVSLAIALFFLVDVLMRVFVEGFKNYFRSKLNTLD
AVIVVGTLLINMTYSFSDLAATDQMPRMVTLLRVLRIVILIRIFRLASQKKQLEVVTRRMVSENKR

>113 danio_vsp gi_70887553_(SEQ ID NO: 185)

TPFVMSFGFRVFGLVLIILDIIMVIVDLSLSEKSRDVGGAPETVSLVISFFFLIDVLLRVYVEGFKVYFSSKLNIVD
ACIVVITLVVTMIYAFSDFSGASLIPRVVTFLRSLRILILVRIFRLASQKRELEKVTRRMVSENKR

>114 xenopus_vsp gi_148230800_(SEQ ID NO: 186)

SPFVMSFGFRVFGVVLIIVDFVLVIVDLSVIDKSREATTAISSISLAISFFFLIDVLLHIFVEGFRQYFSSKLNIFD
AAIVIVTLLVTLVYAFTDFSGATNIPRLVNFLRGLRIIILVRILRLASQKRQLEKVTRRLVSENKR

>115 rat_vsp gi_157820295_(SEQ ID NO: 187)

HFLVSSVAFRIFGILLIFLDVFLVAIDLHATEKNIYIPLEYRAISLAIALFFLVDVLLRVYVEGRQRYFSDVLNTLD
AVVIGVTVLVAVIYTLYDKQFLRNIPRLAVLLRPLRLLILVRILQLAHQKRQLEKLTRQLVSGNKR

>116 mus_vsp gi_40549440_(SEQ ID NO: 188)

GILVSSVAFRIFGIFLVILDVFLVVVDLNVSEKKIYIPLDYRSISLAIALFFLVDILLRVSVEGRRRYFSDVLNTLD
AVVIGVTVVVAVIYALYDKHFLRDIPRLAVLLRPLRLLILIRILQLAHQKRQLERLTRKLVSGNKR

Figure 29Q

\>117 dog_vsp gi_73993164_(SEQ ID NO: 189)

GSSLVSPGHNTNNRIFGILLIFVDLSLIITDLLFTERTMHIPLEYRSISLAIALFFFFDVLLRVYVEGIQRYFSDIL
NYLDAVIIVVTLLIDIIYMFYDFKFLKTIPRLTILFRPLRLIILIRVFHLAHQKRHLEMLTRRMVSGNKR

\>118 human_vsp gi_213972591_(SEQ ID NO: 190)

HSIVSSFAFGIFGVFLVLLDVTLLLADLIFTDSKLYIPLEYRSISLAIGLFFLMDVLLRVFVEGRQQYFSDLFNILD
TAIIVIPLLVDVIYIFFDIKLLRNIPRWTHLVRLLRLIILIRIFHLLHQKRQLEKLMRRLVSENKR

\>119 homo_vsp_gamma gi_40549435_(SEQ ID NO: 191)

HSIVSSFAFGLFGVFLVLLDVTLILADLIFTDSKLYIPLEYRSISLAIALFFLMDVLLRVFVERRQQYFSDLFNILD
TAIIVILLLVDVVYIFFDIKLLRNIPRWTHLLRLLRLIILLRIFHLFHQKRQLEKLIRRRVSENKR

\>120 ciona_vsp gi_76253898_(SEQ ID NO: 192)

RAVIDHLGMRVFGVFLIFLDIILMIIDLSLPGKSESSQSFYDGMALALSCYFMLDLGLRIFAYGPKNFFTNPWEVAD
GLIIVVTFVVTIFYTVLDEYVQETGADGLGRLVVLARLLRVVRLARIFYSHQQMKASSRRTISQ

\>121 Aeropyrum_Kv PDB_1ORS_c(SEQ ID NO: 201)

DVMEHPLVELGVSYAALLSVIVVVVEYTMQLSGEYLVRLYLVDLILVIILWADYAYRAYKSGDPAGYVKKTLYEIPA
LVPAGLLALIEGHLAGLGLFRLVRLLRFLRILLIISRGSKFLSAIAD

\>122 homo_BK gi_119574982_(SEQ ID NO: 193)

GVMISAQTLTGRVLVVLVFALSIGALVIYFIDSSNPIESCQNFYKDFTLQIDMAFNVFFLLYFGLRFIAANDKLWFW
LEVNSVVDFFTVPPVFVSVYLNRSWLGLRFLRALRLIQFSEILQFLNILKTSNSIK

\>123 mouse_BK_mslo gi_4639628_(SEQ ID NO: 194)

GVMISAQTLTGRVLVVLVFALSIGALVIYFIDSSNPIESCQNFYKDFTLQIDMAFNVFFLLYFGLRFIAANDKLWFW
LEVNSVVDFFTVPPVFVSVYLNRSWLGLRFLRALRLIQFSEILQFLNILKTSNSIK

Figure 29R

```
001        --------RKLFS---SHRFQVIIICLVVLDALLVLAELILDLKIIQPDK----------- 39
002        --------KKLFS---SRRFQIVIVFLVIVDALLVLGELLMDLKIIHPDK----------- 39
003        --------RKLFG---SHRFQVIIICLVIMDALLVLAELMLDLKIIQPDK----------- 39
004        --------RKLFS---SHRFQVIIICLVVLDALLVLAELLLDLRIIEPDL----------- 39
005        --------RKLFS---CHRFQVIIICLVILDALLVLAELILDLKIIEADK----------- 39
006        --------RKLFS---AHRFQVIIICLVVLDALLVLAELVLDLKIIEPDK----------- 39
007        --------RKLFS---AHRFQVIIICLVILDALLVLAELVLDLKIIQPDK----------- 39
008        --------RKLFS---SHRFQVIIICLVVLDTLLVLAELILDLRIIQPDK----------- 39
009        --------RKLFS---SHRFQVIIICLVVLDTLLVLAELILDLRIIQPDK----------- 39
010        -------------------EVIIICLVVLDTLLVLAELILDLRIIQPDK----------- 30
011        --------RKLFS---SHRFQVIIICLVILDALLILDLKILDLKIIQGDK----------- 39
012        --------RKLFS---SHRFQVIIICLVILDALLVLAELILDLKIIQGDK----------- 39
013        --------RKLFS---SHRFQVIIICLVVLDALLVLAELLLDLKIIEPDE----------- 39
014        --------KWLFS---SHKFQIVIICLVILDALFVLVEVLLDLELLAEKV----------- 39
015        --------KWLLS---SHKFQIVIICLVILDALFVLVEVLLDLELLAEKV----------- 39
016        --------RKLYS---TERFQIVVVCLVVLDAIFVLCELLIDLSIIEADH----------- 39
017        --------KQMYC---SERFQILVVCLVILDAIFVLVELLLDLSIIKLDH----------- 39
018        --------KWLYC---SDRFQVLVVCLVILDAIFVLVELLLDLSIIKLDH----------- 39
019        --------CEIIH---GQKAQYTIIALVIIDCIIVIAELLVDLEILKVHH----------- 39
020        --------RHILH---SKPIHVAIIVLVVLDSFLVVGELLIDLKVIIVPH----------- 39
021        --------RQLIY---SHKVHIAIVVLVILDALIVIAELLIDLSVIKVHH----------- 39
022        ----------RYIVN---LRYFEMCILLVIAASSIALAAED--PVL--------------- 31
023        ----------HWVVN---LPYFDFFIMVVISMSSIALAAED--PVR--------------- 31
024        ----------LRLVC---NPWFEHISMLVIMLNCVTLGMFRPCEDV--------------- 33
025        ----------IKMVC---NPWFECVSMLVILLNCVTLGMYQPCDDM--------------- 33
026        ----------HRLIT---HKMFDHVVLVIIFLNCITIAMER--PKI--------------- 31
027        ----------IKILV---HSLFSMLIMCTILTNCVFMTMS--------------------- 27
028        ----------IKILV---HSLFNVLIMCTILTNCVFMTMS--------------------- 27
029        ----------IKILV---HSLFSMLIMCTILTNCVFMTMS--------------------- 27
030        ----------IKILV---HSLFNVLIMCTILTNCVFMTMS--------------------- 27
031        ----------IRISV---HSVFSMFIICTVIINCMFMAN---SM----------------- 28
032        ----------IRISV---HSVFSMFIICTVIINCMFMANNS-SV----------------- 30
033        ----------IRVSV---HSLFSMFIIGTVIINCVFMATGP-AK----------------- 30
034        ----------IKILV---HSLFSMFIMCTILTNCVFMAQS--------------------- 27
035        ----------IKVLI---HALFSMFIMITILTNCVFMTMS--------------------- 27
036        ----------VKILV---HSLFSMLIMCTILTNCVFMAQH--------------------- 27
037        ----------IKILV---HSLFSMLIMCTILTNCIFMTLS--------------------- 27
038        ----------IKILV---HSLFSMLIMCTILTNCIFMTMN--------------------- 27
039        ----------IKILV---HSLFSMLIMCTILTNCVFMTLS--------------------- 27
040        ----------IKILV---HSLFNVLIMCTILTNCVFMTMS--------------------- 27
041        ----------IKILI---HSVFSMFIMCTILTNCVFMTFS--------------------- 27
042        ----------IKILI---HSVFSMIIMCTILTNCVFMTFS--------------------- 27
043        ----------IKVSV---HSWFSLFITVTILVNCVGMTQT--------------------- 27
044        ----------IKVLV---HPFFQLFILISVLIDCVFMSLT--------------------- 27
045        ----------ISIVE---WKPFEIIILLTIFANCVALAIYI-PFPE--------------- 32
046        ----------ISIVE---WKPFETIILLTIFANCVALAVYL-PMPE--------------- 32
047        ----------ISIVE---WKPFDILILLTIFANCVALGVYI-PFPE--------------- 32
048        ----------ISLVE---WKPFDIFILLSIFANCVALAVYI-PFPE--------------- 32
049        ----------ISIVE---WKPFEIIILLTIFANCVALAIYI-PFPE--------------- 32
050        ----------IRIVE---WKPFEFLILLTIFANCIALAVYT-PYPG--------------- 32
051        ----------KKITE---WPPFEYMILATIIANCIVLALEQ-HLPD--------------- 32
052        ----------KRITE---WPPFEYMILATIIANCIVLALEQ-HLPD--------------- 32
053        ----------YQIVK---HSWFESFIIFVILLSSGALIFED--VNL--------------- 31
054        ----------YQIVK---HSWFESFIIFVILLSSGALIFED--VNL--------------- 31
055        ----------YRIVE---HSWFESFIVLMILLSSGALAFED--IYI--------------- 31
056        ----------YRIVE---HSWFESFIVLMILLSSGALAFED--IYI--------------- 31
057        ----------YRIVE---HSWFESFIVLMILLSSGALAFED--IYI--------------- 31
058        ---------------------TWDWIILILTFYTAILVPYNVSFKTRQN------------ 28
059        ---------------------GWDWLILLATFYVAVTVPYNVCFIGNEDL----------- 29
060        ---------------------TWDGFILLATLYVAVTVPYSVCVSTAREP----------- 29
```

Figure 30A

```
061        --------HHLCT----SHYLDLFITGVIGLNVVTMAMEH----Y----------------- 29
062        --------FDLVT----SQVFDVIILGLIVTNMIIMMAES----E----------------- 29
063        --------FDLVT----NQAFDITIMVLICLNMVTMMVEK----E----------------- 29
064        --------FDLVT----SQVFDVIILGLIVLNMIIMMAES----A----------------- 29
065        --------RKIVD----SRYFGRGIMIAILVNTLSMGIEY----H----------------- 29
066        --------WHFVV----SPSFEYTIMAMIALNTVVLMMKY----Y----------------- 29
067        --------WRIVV----STPFEYFIMMLIVFNTLLLMMKY----H----------------- 29
068        WNLMEKPFSSVA---AKAIGVASSTFVLSVVALALNTVEEMQ-------------QHSG 44
069        WKFLEKPESSCP---ARVVAVLSFLLILVSSVVMCMGTIPELQ-------------VLDA 44
070        WDLLEKPNSSVA---AKILAIISIMFIVLSTIALSLNTLPELQ-------------SLDE 44
071        RDLLEKPNSSVA---AKILAIVSNLFIVLSTIALSLNTLPELQ-------------EMDE 44
072        WELLEKPNTSFA---APVIAVISILFIVLSTIALTLNTLPQLQ-------------HIDN 44
073        WNILEKPGSSTA---APIFGVISIIFVVVSIINMALMSAELS----------------- 39
074        WIPMENPAYCLS---AKLIAISSLSVVLASIVAMCVHSMSEFQ-------------N--- 41
075        WLTMENPGYSLP---SKLFSCVSISVVLASIAAMCIHSLPEYQ-------------AREA 44
076        RDMVENPHSGIP---GKIFACISISFVAITAVSLCISTMPDVR-------------EEED 44
077        REMVENPQSGLP---GKVFACLSILFVATTAVSLCVSTMPDLR-------------AEED 44
078        WALFEDPYSSRA---APYVAFASLFFILISITTFCLETHEGF--IHISNKTVTQASPIPG 55
079        WALFEDPYSSRA---APFIAFASLFFILVSITTFCLETHEAF--NIVKNKTEP---VING 52
080        WSLFDEPYSSNA---AKTIGVVSVFFICISILSFCLKTHPDMRVPIVRNITVK---TANG 54
081        WLLFEYPESSGP---APVIAIVSVMVILISIVIFCLETLPELK-DDKDFT--GTVHRIDN 54
082        WLLFEYPESSGP---ARGIAIVSVLVILISIVIFCLETLPQFRADGRGGSNEGSGTRMSP 57
083        WLIFEYPESSGS---APAIAIVSVLVILISIITFCLETLPEFR-DERELLRHPPAPHQPP 56
084        WLLFEYPESSGP---APGIAIVSVLVILISIVIFCLETLPEFR-DEKDYP-ASPSQDVFE 55
085        WLLFEYPESSGP---APGIAIVSVLVILVSIVIFCLETLPEFR-DDKDY--AAAAQEQPE 54
086        WLLFEYPESSSP---APGIAIVSVLVILISIVIFCLETLPEFR-DDRDLIMALSTGGHGG 56
087        WLLFEYPESSSA---APAVAVVSVLVVVISITIFCLETLPEFR-EDRELKVVRDPNLNMS 56
088        WLLFEYPESSGP---ARIIAIVSVMVILISIVSFCLETLPIFRDENEDMHGGGVTFHTYS 57
089        WLLFEYPESSGP---APIIAIVSVMVILISIVSFCLETLPIFRDENEDMHGSGVTFHTYS 57
090        WLLFEYPESSGP---APIIAIVSVMVILISIVSFCLETLPIFRDENEDMHGGGVTFHTYS 57
091        WLLFEYPESSGP---APIIAIVSVMVILISIVSFCLETLPIFRDENEDMHGGGVTFHTYS 57
092        WLLFEYPESSQA---APVVAIISVFVILLSIVIFCLETLPEFK----HYKVFNTTTNGTK 53
093        WRAFENPHTSTL---ALVFYYVTGFFIAVSVITNVVETVPCG---------------TVPG 43
094        --------RHMVK----SQVFYWIVLSLVALNTACVAIVH----H----------------- 29
095        --------RHTVK----TQWFYWFVIVLVFLNTVCVAVEH----Y----------------- 29
096        --------QTIMT----DPFTELAITICIIVNTVFLAMEH----H----------------- 29
097        --------RTIMT----DPFTELAITICIIINTVFLAVEH----H----------------- 29
098        --------YFIVM----DPFVDLAITICIVLNTLFMAMEH----H----------------- 29
099        --------WQVFLL----SASLNSFLVACVILVVILLTLELLIDKLLQFSS---------- 40
100        --------WQVCLL----SAGFNCFLVACVILVLLLTLELLIDTKLLQFNN---------- 40
101        --------WQVFLL----SASLNSFLVACVILVVILLTLELLIDIKSLQFSN---------- 40
102        --------WQVFLL----SASVNSFLVACVILVVILLTLELLIDIKLLQFSS---------- 40
103        --------WQVFLL----SASLNSFLVACVILVVILLTLELLIDIKLLQFSS---------- 40
104        --------WQVFLL----SASLNSFLVACVILVVILLTLELLIDIKLLQFSS---------- 40
105        --------WQVFLL----SASLNSFLVACVILVVILLTLELLIDIKLLQFSS---------- 40
106        --------WQVFLL----SASLNSFLVACVILVVILLTLELLIDTKLLQFSN---------- 40
107        --------WQVLLL----SASLNSFLVACVILVVILLTLELLIDIKLLQFSS---------- 40
108        --------RKILH----SVAFYIYILISTFIVTLLLLAELLIDVGVINIPSSPDTVVLNASA 50
109        ------------------KKIMEVLSLIFTFEIVASFILSTYN-------------- 25
110        ---------L-----TTKTEIFGVSLIFVDVALLIVILVTTSKSIRIPF------------ 35
111        ---------SPFVM----SFGFRVFGVVLIIVDFVLVIVDLSVSTQSSGAST---------- 39
112        ---------SPFVM----SFGFRVFGVVLIIVDIIVVIVDLAISEKKRGIRE---------- 39
113        ---------TPFVM----SFGFRVFGLVLIILDIIMVIVDLSLSEKSRDVGG---------- 39
114        ---------SPFVM----SFGFRVFGVVLIIVDFVLVIVDLSVIDKSREATT---------- 39
115        ---------HFLVS----SVAFRIFGILLIFLDVFLVAIDLHATEKNIYIPL---------- 39
116        ---------GILVS----SVAFRIFGIFLVILDVFLVVVDLNVSEKKIYIPL---------- 39
117        ---------GSSLVSPGHNTNNRIFGILLIFVDLSLIITDLLFTERTMHIPL---------- 43
118        ---------HSIVS----SFAFGIFGVFLVLLDVTLLLADLIFTDSKLYIPL---------- 39
119        ---------HSIVS----SFAFGLFGVFLVLLDVTLILADLIFTDSKLYIPL---------- 39
```

Figure 30B

```
120        --------RAVID----HLGMRVFGVFLIFLDIILMIIDLSLPGK-------------- 33
121        --------DVME----HPLVELGVSYAALLSVIVVVEYTMQLS--------------- 32
122        --GVMISAQTLT---GRVLVVLVFALSIGALVIYFIDSSNPIES-------------- 39
123        --GVMISAQTLT---GRVLVVLVFALSIGALVIYFIDSSNPIES-------------- 39

001        ----------------------------------------NNYAAMVFHYMSITILVFFMM 60
002        ----------------------------------------YHIAPKVFHYLSLSILTIFLV 60
003        ----------------------------------------DNYAARVFHYLSIAILTFFMI 60
004        ----------------------------------------SKYSTKVFHYLSLAILAFFVL 60
005        ----------------------------------------NNYVPRVFHYMSLAILTFFMT 60
006        ----------------------------------------NNYAPKVFHYMSLAILTFFMM 60
007        ----------------------------------------NNYANRVFHYMSVAILTFFMM 60
008        ----------------------------------------KNYAAMIFHYMSIAILALFMM 60
009        ----------------------------------------KNYAAMIFHYMSIAILALFMM 60
010        ----------------------------------------KNYAAMIFHYMSIAILALFMM 51
011        ----------------------------------------NNYATKVFHYSSFAILTLFMM 60
012        ----------------------------------------NNYATKVFHYSSFAILTLFMM 60
013        ----------------------------------------QDYAVTAFHYMSFAILVFFML 60
014        ----------------------------------------DHIYPEIFHYLSISVLSFFIL 60
015        ----------------------------------------DHIYPEIFHYLSISVLTFFIL 60
016        ----------------------------------------HRIAPQVFHYLSLAILTFFMV 60
017        ----------------------------------------GSVAPEVFHFLSLGLVVFFLL 60
018        ----------------------------------------GNVIPEVFHYLSLAIVTFFVV 60
019        ----------------------------------------DNPAPHILHDVSIAILSLFII 60
020        ----------------------------------------GNPAPEILHGFSLSILSIFMV 60
021        ----------------------------------------TSPLARAFHFTSIAILAIFLV 60
022        ----------------------------------------TN-SERNKVLRYFDYVFTGVFTF 53
023        ----------------------------------------EN-SRRNKILNYFDYAFTGVFTI 53
024        ----------------------------------------ECRSERCSILEAFDDFIFAFFAV 56
025        ----------------------------------------DCLSDRCKILQVFDDFIFIFFAM 56
026        ----------------------------------------DPHSAERIFLTLSNYIFTAVFLA 54
027        -------------------------------------NPPDWTKNVEYTFTGIYTF 46
028        -------------------------------------NPPDWTKNVEYTFTGIYTF 46
029        -------------------------------------NPPDWTKNVEYTFTGIYTF 46
030        -------------------------------------NPPDWTKNVEYTFTGIYTF 46
031        -------------------------------------ERSFDN-DIPEYVFIGIYIL 47
032        -------------------------------------DSRPSS-NIPEYVFIGIYVL 49
033        -------------------------------------NSNSNNTDIAECVFTGIYIF 50
034        -------------------------------------ETPSWNKYVEYTFTGIYTF 46
035        -------------------------------------DPPPWSKNVEYTFTGIYTF 46
036        -------------------------------------DPPPWTKYVEYTFTAIYTF 46
037        -------------------------------------NPPEWTKNVEYTFTGIYTF 46
038        -------------------------------------NPAEWTKNVEYTFTGIYTF 46
039        -------------------------------------NPPDWTKNVEYTFTGIYTF 46
040        -------------------------------------NPPDWTKNVEYTFTGIYTF 46
041        -------------------------------------NPPEWSKQVEYTFTGIYTF 46
042        -------------------------------------NPPEWSKNVEYTFTGIYTF 46
043        -------------------------------------ELPDR---IEYVFTVIYTF 43
044        -------------------------------------NLPKWRPVLENTLLGIYTF 46
045        ----------------------------------------DDSNATNSNLERVEYLFLIIFTV 55
046        ----------------------------------------DDNNTLNLGLEKLEYFFLIVFSI 55
047        ----------------------------------------DDSNTANRNLEQVEYVFLVIFTV 55
048        ----------------------------------------DDSNSTNHNLEKVEYAFLIIFTV 55
049        ----------------------------------------DDSNATNSNLERVEYLFLIIFTV 55
050        ----------------------------------------SDSNVTNQTLEKVEYVFLVIFTA 55
051        ----------------------------------------DDKTPMSERLDDTEPYFIGIFCF 55
052        ----------------------------------------GDKTPMSERLDDTEPYFIGIFCF 55
053        ----------------------------------------PSRPQVEKLLPCTDNIFTFIFLL 54
054        ----------------------------------------PSRPQVEKLLKCTDNIFTFIFLL 54
055        ----------------------------------------EKKKTIKIILEYADKIFTYIFIL 54
056        ----------------------------------------EKKKTIKIILEYADKIFTYIFIL 54
057        ----------------------------------------EKKKTIKIILEYADKIFTYIFIL 54
```

Figure 30C

```
058   ----------------------------------------NVAW---LVVDSIVDVIFLV  45
059   ----------------------------------------STTR-STTVSDIAVEILFII  48
060   ----------------------------------------SAARGPPSVCDLAVEVLFIL  49
061   ----------------------------------------QQPQILDEALKICNYIFTVIFVL  52
062   ----------------------------------------GQPNEVKKIFDILNIVFVVIFTV  52
063   ----------------------------------------GQTEYMDYVLHWINMVPIILFTG  52
064   ----------------------------------------DQPKDVKKTFDILNIAFVVIFTI  52
065   ----------------------------------------EQPEELTNALEISNIVFTSLFAL  52
066   ----------------------------------------SAPCTYELALKYLNIAFTMVFSL  52
067   ----------------------------------------NQGDMYEKSLKYINMGFTGMFSV  52
068   QG--------------------------------------EGGPDLRPILEHVEMLCMGFFTL  69
069   E---------------------------------------GNRVEHPTLENVETACIGWFTL  67
070   F---------------------------------------GQSTDNPQLAHVEAVCIAWFTM  67
071   F---------------------------------------GQPNDNPQLAHVEAVCNAWFTM  67
072   ----------------------------------------GTPQDNPQLAMVEAVCYTWFTL  66
073   ----------------------------------------WLDLQ-LLEILEYVCISWFTG  59
074   ----------------------------------------EDGEVDDPVLEGVEIACIAWFTG  64
075   AAAVAAVAAG------------------------------RSAEGVRDDPVLRRLEYFCIAWFSF  79
076   RG--------------------------------------ECSQKCYDIFVLETVCVAWFSF  68
077   QG--------------------------------------ECSRKCYYIFIVETICVAWFSL  68
078   APPENITNVE------------------------------VETEPFLTYVEGVCVVWFTF  85
079   TS--VVLQYE------------------------------IETDPALTYVEGVCVVWFTF  80
080   SNGWFLDKTQ------------------------------TNAHIAFFYIECVCNAWFTF  84
081   TTVIYNSN--------------------------------IFTDPFFIVETLCIIWFTF  81
082   ASRGSHEEEDEDEDSYAFPGSIPSGGLGTGGTSSFSTLGGSFFTDPFFLVETLCIVWFTF  117
083   APAPGANGS--------------GVMAPPSGPTVAPLLPRTLADPFFIVETTCVIWFTF  101
084   AANNSTSG---------------ASSGASS-------FSDPFFVVETLCIIWFSF  89
085   AARNGTSG---------------PPAAAG--------FADPFFVVETLCIIWFSF  86
086   LLNDTSAP---------------HPENSGHT------IFNDPFFIVETVCIVWFSF  91
087   KTVLSQTM--------------------------------FTDPFFMVESTCIVWFTF  82
088   QSTIGYQQS-------------------------------TSFTDPFFIVETLCIIWFSF  86
089   NSTIGYQQS-------------------------------TSFTDPFFIVETLCIIWFSF  86
090   NSTIGYQQS-------------------------------TSFTDPFFIVETLCIIWFSF  86
091   NSTIGYQQS-------------------------------TSFTDPFFIVETLCIIWFSF  86
092   IEEDEVPD--------------------------------ITDPFFLIETLCIIWFTF  79
093   SKELPCGER-------------------------------YSVAFFCLDTACVMIFTV  70
094   ----------------------------------------NQPQWLTHLLYYAEFLFLGLFLL  52
095   ----------------------------------------GQPSFLTEFLYYAEFIFLGLFMS  52
096   ----------------------------------------NMDNSLKDILKIGNWVFTGIFIA  52
097   ----------------------------------------NMDDNLKTILKIGNWVFTGIFIA  52
098   ----------------------------------------PMTEEFKNVLAVGNLIFTGIFAA  52
099   ----------------------------------------ASQFASVVHWISLIILSVFFT  61
100   ----------------------------------------AFQFACIIHWISLVILSVFFT  61
101   ----------------------------------------SSQFAGVSHWISLVILSVFFS  61
102   ----------------------------------------AFQFAGVIHWISLVILSVFFS  61
103   ----------------------------------------AFQFAGVIHWISLVILSVFFS  61
104   ----------------------------------------AFQFAGVIHWISLVILSVFFS  61
105   ----------------------------------------AFQFAGVIHWISLVILSVFFS  61
106   ----------------------------------------AFQFAGVIHWISLVILSVFFS  61
107   ----------------------------------------AFQFAAVIHWISLVILSVFFS  61
108   LSTLKVQTP-------------------------------AQKTSTILHWISPSFLSLFFI  80
109   ----------------------------------------PPYQDLLIKLDYISIMFFTF  45
110   ----------------------------------------AYRVVSLLIALFFLF  50
111   ----------------------------------------AISSISLSISFFFLI  54
112   ----------------------------------------ILEGVSLAIALFFLV  54
113   ----------------------------------------APETVSLVISFFFLI  54
114   ----------------------------------------AISSISLAISFFFLI  54
115   ----------------------------------------EYRAISLAIALFFLV  54
116   ----------------------------------------DYRSISLAIALFFLV  54
117   ----------------------------------------EYRSISLAIALFFFF  58
118   ----------------------------------------EYRSISLAIGLFFLM  54
119   ----------------------------------------EYRSISLAIALFFLM  54
```

Figure 30D

```
120  ---------------------------------------SESSQSFYDGMALALSCYFML 54
121  ---------------------------------------GEYLVRLYLVDLILVIILWA 52
122  ---------------------------------------CQNFYKDFTLQIDMAFNVFFLL 61
123  ---------------------------------------CQNFYKDFTLQIDMAFNVFFLL 61

001  EIIFKLFV------------FRLE-FFHHKFEILDAVVVVVSFILDIVLLF-------- 98
002  EVGFKIFV------------YGRE-FFHHKFEVLDSIVVVVSFILDLVLLF-------- 98
003  EVALKLYV------------FRLE-FFYHKFEILDAVIVISFVLDIVLLF-------- 98
004  EISLKVFV------------FRLE-FFHHKFEILDAIVVVVSFVLDLILLF-------- 98
005  EVSLKIFV------------FRLE-FFHHKFEILDAVVVVVSFVLDIVLIF-------- 98
006  EIFFKIFV------------FRLE-FFHHKFEILDTIVVVISFILDLVLLF-------- 98
007  EIFFKIFV------------FRFE-FFHHKFEILDAIVVVVSFVLDVVLLF-------- 98
008  EITFKLFV------------FRLE-FFHHKFEILDAVVVVVSFVLDVVLLF-------- 98
009  EITFKLFV------------FRLE-FFHHKFEILDAVVVVVSFVLDVVLLF-------- 98
010  EITFKLFV------------FRLE-FFHHKFEILDAVVVVVSFVLDVVLLF-------- 89
011  EVFLKLFV------------FRLE-FFHHKFEILDTFVVVVSFILDLVLLF-------- 98
012  EVFLKLFV------------FRLE-FFHHKFEILDTFVVVVSFILDLVLLF-------- 98
013  EIFFKIFV------------FRLE-FFHHKFEILDAFVVVVSFVLDLVLLF-------- 98
014  EIAGKLYA------------FRLE-FFHHKFEVFDAAIVVISFIIDIVYIS-------- 98
015  EIAGKLYA------------FRLE-FFHHKFEVFDAAIVVISFIIDIVYIS-------- 98
016  ELAGKIFA------------YRLE-FLRHKFEVFDGIVVVSFILDIIYIS-------- 98
017  ELAGKLFA------------FRKE-FFDHKFEVFDGLVVTVSFVLDVAFIF-------- 98
018  ELVGKLFA------------FRKE-FFHHKFEVVVVSFVLDVAFIF-------- 98
019  ELIVKIYA------------MGME-FFHHKLEVFDGIVVIVSFALDIAFS-------- 97
020  EIALKIIA------------DHRH-FIRHKVEVLDAVVVVISFGVDIALIFV-G----- 100
021  EIVLKLYA------------SDLA-FFLHYFEVFDALIVIVSFVLDIAYS-------- 97
022  EMVIKMIDQGL---------ILQDGSYFRDLWNILDFVVVVGALVAFALAN-------AL 97
023  EMLLKIVDLGV---------ILHPGSYLREFWNIMDAVVVICAAVSFGFD--------MS 96
024  EMVIKMVALGL---------FG-QKCYLGDTWNRLDFFIVMAGMMEYSLD---------- 96
025  EMVLKMVALGI---------FG-KKCYLGDTWNRLDFFIVMAGMVEYSLD---------- 96
026  EMTVKVVALGW---------CFGEQAYLRSSWNVLDGLLVLISVIDILVS--------MV 97
027  ESLIKILARGF---------CLEDFTFLRDPWNWLDFTVITFAYVTEF------------ 85
028  ESLIKILARGF---------CLEDFTFLRNPWNWLDFTVITFAYVTEF------------ 85
029  ESLIKILARGF---------CLEDFTFLRDPWNWLDFTVITFAYVTEF------------ 85
030  ESLIKILARGF---------CLEDFTFLRDPWNWLDFTVITFAYVTEF------------ 85
031  EAVIKILARGF---------IVDEFSFLRDPWNWLDFIVIGTAIATCFPG---------- 88
032  EAVIKILARGF---------IVDEFSYLRDPWNWLDFIVIGTAIAPCFLG---------- 90
033  EALIKILARGF---------ILDEFSFLRDPWNWLDSIVIGIAIVSYIPG---------- 91
034  ESLIKILARGF---------CMTEFTFLRDPWNWLDFSVIVMAYITEF------------ 85
035  ESLIKILARGF---------CVDDFTFLRDPWNWLDFSVIMMAYLTEF------------ 85
036  ESLVKILARGF---------CLHAFTFLRDPWNWLDFSVIVMAYTTEF------------ 85
037  ESLIKILARGF---------CVGEFTFLRDPWNWLDFVVIVFAYLTEF------------ 85
038  ESLVKIFARGF---------CVGEFTFLRDPWNWLDFIVIVFAYLTEF------------ 85
039  ESLIKILARGF---------CLEDFTFLRDPWNWLDFSVIVMAYVTEF------------ 85
040  ESLIKILARGF---------CLEDFTFLRDPWNWLDFTVITFAYVTEF------------ 85
041  ESAVKIIARGF---------CIDGFTFLRDPWNWLDFMVISMAYVTEF------------ 85
042  ESLVKIARGF----------CIDGFTFLRDPWNWLDFSVIMMAYVTEF------------ 85
043  EALIKILARGF---------CLNEFAYLRDPWDWLDFSVITLAYIGEA------------ 82
044  EILVKLFARGV---------WAGSFSFLGDPWNWLDFSVTVFEVIIRY------------ 85
045  EAFLKVIAYGL---------LFHPNAYLRNGWNLLDFIIVVVGLFSAILEQATKA-DGAN 105
046  EAAMKIIAYGF---------LFHQDAYLRSGWNVLDFIIVFLGVFTVILEQVNIIQTNTA 106
047  ETVLKIVAYGL---------VLHPSAYIRNGWNLLDFIIVVVGLFSVLLEQGPGRPGDAP 106
048  ETFLKIIAYGL---------LLHPNAYVRNGWNLLDFVIVVVGLFSVILEQLTKETEGGS 106
049  EAFLKVIAYGL---------LFHPNAYLRNGWNLLDFIIVVVGLFSAILEQATKA-DGAN 105
050  ECVMKILAYGF---------VLHNGAYLRNGWNLLDFTIVVIGAISTALSQLMKD----- 101
051  EAGIKIIALGF---------AFHKGSYLRNGWNVMDFVVVLTGILATVGT---------- 96
052  EAGIKIIALGF---------VFHKGSYLRNGWNVMDFVVVLTGILATAGT---------- 96
053  EMILKWVAFGF---------RR----YFTSAWCWLDFLIVVVSVLSLMN----------- 90
054  EMILKWVAFGF---------RK----YFTSAWCWLDFLIVVVSGLSLTN----------- 90
055  EMLLKWVAYGY---------KT----YFTNAWCWLDFLIVDVSLVTLVAN---------- 91
056  EMLLKWVAYGY-----------KT-----YFTNAWCWLDFLIVDVSLVTLVAN-------- 91
057  EMLLKWVAYGY-----------KT-----YFTNAWCWLDFLIVDVSLVTLVAN-------- 91
058  DIVLNFHTTFVGPAGEVISDPKLIRMNYLKTWFVIDLLSCLFYDVINAFENVDEVSAFMG 105
```

Figure 30E

```
059  DIILNFRTTYVSKSGQVIFEARSICIHYVTTWFIIDLIAALPFDLLYAFN----VTVVSL 104
060  DIVLNFRTTFVSKSGQVVFAPKSICLHYVTTWFLLDVIAALPFDLLHAFK----VNVYFG 105
061  ESVFKL----V---------AFGPRRPFQDRWNQLDLAIVLLSIMGITLEEIEV------  93
062  ECLIKV----F---------ALR-QHYFTNGWNLFDCVVVVLSIISTLVSGLE-------  91
063  ECVLKL----I---------SLR-HYYFTVGWNIFDFVVVILSIVGMFLAEMI-------  91
064  ECLIKV----F---------ALR-QHYFTNGWNLFDCVVVVLSIISTLVSRLE-------  91
065  EMLLKL----L---------VYGPFGYIKNPYNIFDGVIVVISVWEIVGQQGG-------  92
066  ECVLKV----I---------AFGPLNYFRDTWNIFDFITVIGSITEIILTDSK-------  92
067  ETVLKI----I---------GFGVKNPFKDPWNIFDLITVLGSIVDALWMEFG-------  92
068  EYLLRLAS------------TPDLRRPARSALNLVDLVAILPLYLQLLLECPTGEGHQRG 117
069  EYLLRLFS------------SPNKLHFALSFMNIVDVLAILPFYVSLTLTHLGA------ 109
070  EYLLRFLS------------SPKKWKFFKGPLNAIDLLAILPYYVTIFLTESNK------ 109
071  EYLLRFLS------------SPNKWKFFKGPLNVIDLLAILPYYVTIFLTESNK------ 109
072  EYILRFSA------------SPDKWKFFKGGLNIIDLLAILPYFVSLFLLETNKN----- 109
073  EFVLRFLC------------VRDRCRFLRKVPNIIDLLAILPFYITLLVESLSGS----- 102
074  ELAVRLAA------------APCQKKFWKNPLNIIDFVSIIPFYATLAVDTKEEES---- 108
075  EVSSRLLL------------APSTRNFFCHPLNRLIDIVSVLPFYLTLLAGAALGDQG--G 125
076  EFLLRSIQ------------AENKCAFLKTPLNIIDILAILPFYISLIVDMASTKNSSKP 116
077  EPCLRFVQ------------AQDKCQFFQGPLNIIDILAISPYYVSLAVSEEPPEDGERP 116
078  EFLMRVTF------------CPDKVEFLKSSLNIIDCVAILPFYLEVGLSGLS------- 126
079  EFLVRIVF------------SPNKLEFIKNLLNIIDFVAILPFYLEVGLSGLS------- 121
080  EILVRFIS------------SPNKWEFIKSSVNIIDYIATLSFYIDLVLQRFA------- 125
081  ELVVRFFA------------CPSKTDFFKNIMNFIDIVAIIPYFITLGTEIAEQE----- 124
082  ELLVRFSA------------CPSKAAFFRNIMNIIDLVAIFPYFITLGTELVQRHEQQ-- 163
083  ELLVRFFA------------CPSKAGFFSRNIMNIIDVVAIFPYFITLGTELAEQQPG-- 146
084  ELLVRFFA------------CPSKATFSRNIMNLIDIVAIIPYFITLGTELAERQ----- 131
085  ELLVRFFA------------CPSKATFSRNIMNLIDIVAIIPYFITLGTELAERQ----- 129
086  EFVVRCFA------------CPSQALFFKRIMNIIDIVSILPYFITLGTDLAQQQ----- 134
087  ELVLRFVV------------CPSKTDFFRNIMNIIDIISIIPYFATLITELVQET----- 125
088  EFLVRFFA------------CPSKAGFFTNIMNIIDIVAIIPYYVTI--FLTESN----- 127
089  EFLVRFFA------------CPSKAGFFTNIMNIIDIVAIIPYFITLGTELAEKP----- 129
090  EFLVRFFA------------CPSKAGFFTNIMNIIDIVAIIPYFITLGTELAEKP----- 129
091  EFLVRFFA------------CPSKAGFFTNIMNIIDIVAIIPYFITLGTELAEKP----- 129
092  ELTVRFLA------------CPNKLNFCRDVMRNVIDIIAIIPYFITLATVVAEEEDTLNL 127
093  EYLLRLFA------------APSRYRFIRSVMSIIDVVAIMPYYIGLVMTNNE------- 111
094  EMSLKM----Y---------GMGPRLYFHSSFNCFDFGVTVGSIFEVVWAIFRP------  93
095  EMFIKM----Y---------ALGPRIYFESSFNRFDCVVISGSIFEVIWSEVK-------  92
096  EMCLKI----I---------ALDPYHYFRHGWNIFDSIVALVSLADVLFHKLS-------  92
097  EMCLKI----I---------ALDPYHYFRHGWNVFDSIVALLSLADVLYNTLSD------  93
098  EMVLKL----I---------AMDPYFQVGWNRIFDSLIVTLSLIELFLADVE--------  92
099  ETILRIVV------------LGIWDYIENKIEVFDGAVIILSLAPMVASTVANG------ 103
100  ETVFRIVV------------LGIWDYIENKVEVFDGAVIVLSLAPMVASTVANG------ 103
101  ETILRIVV------------LGIWDYIENKIEVFDGAVIILSLAPMVASTIANG------ 103
102  ETVLRIVV------------LGIWDYIENKIEVFDGAVIILSLAPMVASTVANG------ 103
103  ETVLRIVV------------LGIWDYIENKIEVFDGAVIILSLAPMVASTVANG------ 103
104  ETVLRIVV------------LGIWDYIENKIEVFDGAVIILSLAPMVASTVANG------ 103
105  ETVLRIVV------------LGIWDYIENKIEVFDGAVIILSLAPMVASTVANG------ 103
106  ETVLRIVV------------LGIWDYIENKIEVFDGAVIILSLAPMVASTVANG------ 103
107  ETILRIVV------------LGIWDYIENKIEVFDGAVIILSLAPMVASTVANG------ 103
108  EIMFRLYA------------WKLN-IIRSIVSVFDCSIVTMAIATNLAATLAAG------ 121
109  EFIYNFYY------------VEDKAKFFKDIYNIVDAIVVIAFLLYSLQVFYS-------  86
110  DVLLRIFA------------EGFRNYFSIKLNILDAFIVVGTLMIDIVVIYVN-------  91
111  DVLLHIFV------------EGFRQYFSSKLNIFDAVIVIVTLLVTLVYAFTD-------  95
112  DVLMRVFV------------EGFKNYFRSKLNTLDAVIVVGTLLIRMTYSFSD-------  95
113  DVLLRVYV------------EGFKVYFSSKLNIVDACIVVITLVVTMIYAFSD-------  95
114  DVLLHIFV------------EGFRQYFSSKLNIFDAAIVIVTLLVTLVYAFTD-------  95
115  DVLLRVYV------------EGRQRYFSDVLNTLDAVVIGVTVLVAVIYTLYD-------  95
116  DILLRVSV------------EGRRRYFSDVLNTLDAVVIGVTVVVAVIYALYD-------  95
117  DVLLRVYV------------EGIQRYFSDILNYLDAVIIVVTLLIDIIYMFYD-------  99
118  DVLLRVFV------------EGRQQYFSDLFNILDTAIIVIPLLVDVIYIFFD-------  95
119  DVLLRVFV------------ERRQQYFSDLFNILDTAIIVILLLVDVVYIFFD-------  95
```

Figure 30F

```
120   DLGLRIFA------------YGPKNFFTNPWEVADGLIIVVTFVVTIFYTVLDEY----  97
121   DYAYRAYK------------SGDPAGYVKKTLYEIPALVPAGLLALIEGHLAG------  93
122   YFGLRFIA------------ANDKLWFWLEVNSVVDFFTVPPVFVSVYLNRSWLG----- 104
123   YFGLRFIA------------ANDKLWFWLEVNSVVDFFTVPPVFVSVYLNRSWLG----- 104

001   ---------------------QEHQFEALGLLILLRLWRVARIINGIIISVKTRSERQLLRL 139
002   ---------------------REHEFEAVGLLILLRLWRVARIINGIILSVKTRSEQQVSKL 139
003   ---------------------QEHAFEALGLLILLRLWRVARIINGIIISVKTRSERQLSRL 139
004   ---------------------KNHHFEALGLLILLRLWRVARIINGIIISVKTRSERQILRL 139
005   ---------------------REHEFEALGLLILLRLWRVARIINGIIISVKTRSERQLLRL 139
006   ---------------------REHQFEALGLLILLRLWRVARIINGIIISVKTRSERQLLRL 139
007   ---------------------REHEFEALGLLILLRLWRVARIINGIIISVKTRSERQLLRL 139
008   ---------------------QEHEFEALGLLILLRLWRVARIINGIIISVKTRSERQLLRL 139
009   ---------------------QEHEFEALGLLILLRLWRVARIINGIIISVKTRSERQLLRL 139
010   ---------------------QEHEFEALGLLILLRLWRVARIINGIIISVKTRSERQLLRL 130
011   ---------------------QKHEFEALGLLILLRLWRVARIINGIIISVKTRSERQLLRL 139
012   ---------------------QKHEFEALGLLILLRLWRVARIINGIIISVKTRSERQLLRL 139
013   ---------------------KSHHFEALGLLILLRLWRVARIINGIIISVKTRSERQILRL 139
014   ---------------------REDIFNAVGLLILLRLWRVARIVNGIITVSVKTQAEDKIHRL 139
015   ---------------------REDIFNAVGLLILLRLWRVARIVNGVIVSVKTRAEEKMHKL 139
016   ---------------------KEDAFDAMGLLILLRLWRVARIINGILVSVQNRANHRVEKL 139
017   ---------------------REDAFDGIGLLILLRLWRVARIINGILVSVKTREQQKLHKL 139
018   ---------------------REDAFDGIGLLILLRLWRVARIINGILVSVKTREQQKLHKL 139
019   ---------------------GGNAAEGASLLIILRLWRVTRIVNGIILSVKMQDEKKIHHL 138
020   ---------------------ESEALAAIGLLVILRLWRVFRIINGIITVTVKTKADDRVHEI 141
021   ---------------------NSEALSGVGLLVVLRLWRIARIVNGIISSVKSQANDKIHHL 138
022   ---------------------GTNRGRDIKTIKSLRVLRVLRPLKTIKRLPKLKAVFDCVVT 138
023   ---------------------GSSAGQNLSTIKSLRVLRVLRPLKTIKRVPKLKAVFDCVVN 137
024   ------------------------GHNVSLSAIRTVRVLRPLRAINRVPSMRILVTLLLD 132
025   ------------------------LQNINLSAIRTVRVLRPLRAINRVPSMRILVNLLLD 132
026   ---------------------SDSGTKILGMLRVLRLLRTLRPLRVISRAQGLKLVVETLMS 138
027   ------------------------VNLGNVSALRTFRVLRALKTISVIPGLKTIVGALIQ 121
028   ------------------------VNLGNVSALRTFRVLRALKTISVIPGLKTIVGALIQ 121
029   ------------------------VDLGNVSALRTFRVLRALKTISVIPGLKTIVGALIQ 121
030   ------------------------VNLGNVSALRTFRVLRALKTISVIPGLKTIVGALIQ 121
031   ------------------------SQVN-LSALRTFRVFRALKAISVISGLKVIVGALLR 123
032   ------------------------NKVNNLSTLRTFPVLPALKAISVISGLKVIVGALLR 126
033   ------------------------ITIK-LLPLRTFPVFPALKAISVVSRLKVIVGALLR 126
034   ------------------------VDLGNVSALRTFPVLPALKTISVISGLKTIVGALIQ 121
035   ------------------------VDLGNISALRTFPVLPALKTITVIPGLKTIVGALIQ 121
036   ------------------------VDLGNVSALRTFPVLPALKTISVISGLKTIVGALIQ 121
037   ------------------------VNLGNVSALRTFPVLPALKTISVIPGLKTIVGALIQ 121
038   ------------------------VNLGNVSALRTFPVLPALKTISVIPGLKTIVGALIQ 121
039   ------------------------VSLGNVSALRTFPVLPALKTISVIPGLKTIVGALIQ 121
040   ------------------------VDLGNVSALRTFPVLPALKTISVIPGLKTIVGA--- 118
041   ------------------------VDLGNVSALRTFPVLPALKTISVIPGLKTIVGALIQ 121
042   ------------------------VDLGNVSALRTFPVLPALKTISVIPGLKTIVGALIQ 121
043   ------------------------TALRGISGLRTFPVLPALKTVSVIPGLKVIVGALIH 118
044   ------------------------SPLDFIPTLQTAPTLRILKIIPLNQGLKSLVGVLIH 121
045   ------------------------ALGGKGAGFDVKALRAFPVLRPLRLVSGVPSLQVVLNSIIK 146
046   ------------------------PMSSKGAGLDVKALRAFPVLRPLRLVSGVPSLQVVLNSIFK 147
047   ------------------------RTGGKPGGFDVKALRAFPVLRPLRLVSGVPSLHIVVNSIMK 147
048   ------------------------RSGGKPGGFDVKALRAFPVLRPLRLVSGVPSLQVVLNSIIK 147
049   ------------------------ALGGKGAGFDVKALRAFPVLRPLRLVSGVPSLQVVLNSIIK 146
050   ----------------------------AFDVKALRAFPVLRPLRLVSGVPSLQVVLNSILK 135
051   ----------------------------EFDLRTLRAVPVLRPLKLVSGIPSLQVVLKSIMK 130
052   ----------------------------DFDLRTLRAVPVLRPLKLVSGIPSLQVVLKSIMK 130
053   ------------------------LPSLKSFRTLPALRPLRALSQFEGMKVVVYALIS 124
054   ------------------------LPNLKSFRNLPALRPLRALSQFEGMKVVVNALMS 124
055   ------------------------TLGYSDLGPIKSLRTLPALRPLRALSRFEGMRVVVNALIG 131
056   ------------------------TLGYSDLGPIKSLRTLRALRPLRALSRFEGMRVVVNALIG 131
057   ------------------------TLGYSDLGPIKSLRTLRALRPLRALSRFEGMRVVVNALIG 131
058   DPGKIGFADQIPPFLEGRESQGISSLFSSLKVVRLLRLGRVARKLDHYIEYGAAVLV---- 162
```

Figure 30G

```
059   ------------------------------VHLLKTVRLLRLLRLLQKLDRYSQHSTIVLTLLM 138
060   ------------------------------AHLLKTVRLLRLLRLLPRLDRYSQYSAVVLT--- 136
061   ----------------------------NASLPINPTIIRIMRVLRIARVLKLLKMAVGMRALLDTVMQ 134
062   ----------------------------NSNV-FPPTLFRIVRLARIGRILRLVRAARGIRTLLFALMM 131
063   ----------------------------EKYF-VSPTLFRVVRLARIGRILRLIKGAKGIRTLLFALMM 131
064   ----------------------------DSDISFPPTLFRVVRLARIGRILRLVRAARGIRTLLFALMM 132
065   -------------------------------GLSVLRTFRLMRVLKLVRFLPALQRQLVVLMK 124
066   --------------------------LVNTSGFNMSFLKLFRAARLIKLLRQGYTIRILLWTFVQ 131
067   --------------------------HDDSNSINVGFLRLFRAARLIKLLRQGYTIRILLWT--- 128
068   ----------------------QTVGSVGKVGQVLRVMRLMRIFRILKLARHSTGLRAFGFTLRQ 160
069   ----------------------RMMELTNVQQAVQALRIMRIARIFKLARHSSGLQTLTYALKR 151
070   ----------------------SVLQFQNVRRVVQIFRIMRILRILKLARHSTGLQSLGFTLRR 151
071   ----------------------SVLQFQNVRRVVQIFRIMRILRILKLARHSTGLQSLGFTLRR 151
072   ----------------------ATDQFQDVRRVVQVFRIMRILRVLKLARHSTGLQSLGFTLRN 151
073   ----------------------QTTQELENVGRIVQVLRLLRALRMLKLGRHSTGLRSLGMFITQ 145
074   ----------------------EDIENMGKVVQILRLMRIFRILKLARHSVGLRSLGATLRH 148
075   ----------------------TGGKEFGHLGKVVQVFRLMRIFRVLKLARHSTGLRSLGATLKH 168
076   G-------------GGAGNKYLERVGLVLRFLRALRILYVMRLARHSLGLQTLGLTVRR 162
077   ----------------------SGSSYLEKVGLVLRVLRALRILYVMRLARHSLGLQTLGLTVRR 159
078   ----------------------SKAA-KDVLGFLRVVRFVRILRIFKLTRHFVGLRVLGHTLRA 167
079   ----------------------SKAA-KDVLGFLRVVRFVRILRIFKLTRHFVGLRVLGHTLRA 162
080   ----------------------SHLENADILEFFSIIR---IMRLFKLTRHSSGLKILIQTFRA 164
081   ----------------------GNQKGEQATSLAILRVIRLVRVFRIFKLSRHSKGLQILGQTLKA 168
082   -------------PVSGGSGQNRQQAMSLAILRVIRLVRVFRIFKLSRHSKGLQILGKTLQA 212
083   -------------GGGGGQNGQQAMSLAILRVIRLVRVFRIFKLSRHSKGLQILGKTLQA 193
084   ----------------GNGQQAMSLAILRVIRLVRVFRIFKLSRHSKGLQILGQTLKA 173
085   ----------------GNGQQAMSLAILRVIRLVRVFRIFKLSRHSKGLQILGQTLKA 171
086   --------------GGGNGQQQAMSFAILRIIRLVRVFRIFKLSRHSKGLQILGHTLRA 180
087   ----------------EPSAQQNMSLAILRIIRLVRVFRIFKLSRHSKGLQILGQTLKA 168
088   ---------------KSVLQFQNVR--RVVQIFRIMRILRIFKLSRHSKGLQ-------- 162
089   ---------------EDAQQGQQAMSLAILRVIRLVRVFRIFKLSRHSKGLQILGQTLKA 174
090   ---------------EDAQQGQQAMSLAILRVIRLVRVFRIFKLSRHSKGLQILGQTLKA 174
091   ---------------EDAQQGQQAMSLAILRVIRLVRVFRIFKLSRHSKGLQILGQTLKA 174
092   PK---------APVSPQDKSSNQAMSLAILRVIRLVRVFRIFKLSRHSKGLQILGRTLKA 178
093   ----------------------DVSGAFVTLRVFRVFRIFKFSRHSQGLRILGYTLKS 147
094   ----------------------GTSFGISVLRALRLLRIFKITKYWASLRNLVVSLMS 129
095   ----------------------GGSFGLSVLRALRLLRIFKVTKYWSSLRNLVISLLN 128
096   -------------------KNLSFLASLRVLRVFKLAKSWPTLNTLIKIIGH 125
097   -------------------NNRSFLASLRVLRVFKLAKSWPTLNTLIKIIGH 126
098   ------------------GLSVLRSFRLLRVFKLAKSWPTLNMLIKIIGN 124
099   --------------------PSSPWDAISLIITLRIWRVKRIIDAYVLPVKVEMEMVIQQY 144
100   --------------------PSSPWDAISLIITLRIWRVKRIIDAYVLQVKVEMELEIQQY 144
101   --------------------PSSPWDAISLTIALRIWRVKRIIDAYVLPVKVELEMVIQQY 144
102   --------------------PRSPWDAISLIIMLRIWRVKRVIDAYVLPVKVEMEMVIQQY 144
103   --------------------PRSPWDAISLIIMLRIWRVKRVIDAYVLPVKLEMEMVIQQY 144
104   --------------------PRSPWDAISLIIMLRIWRVKRVIDAYVLPVKLEMEMVIQQY 144
105   --------------------PRSPWDAISLIIMLRIWRVKRVIDAYVLPVKVEMEMVIQQY 144
106   --------------------PRSPWDAISLIIMFRIWRVKRVIDAYVLPVKLEMEMVTQQY 144
107   --------------------PRSPWDAISLIIMFRIWRVKRVIDAYVLPVKLEMEMVTQQY 144
108   --------------------STSPFDAISLLIILRFIRIHSLIQRCVSDSKQEIREKLTKT 162
109   --------------------KAFLGLRVINLLRILVLLRIIKLRKLEENQALIN----- 120
110   --------------------TGGVKQIPRLAILLRPLRIIILIRIFRLAVQKKQLEKVTRR 132
111   --------------------FSGASNIPRMVNFLRALRIIILIRILRLASQKRQLEKVTRR 136
112   --------------------LAATDQMPRMVTLLRVLRIVILIRIFRLASQKKQLEVVTRR 136
113   --------------------FSGASLIPRVVTFLRSLRILILVRIFRLASQKRELEKVTRR 136
114   --------------------FSGATNIPRLVNFLRGLRIIILVRILRLASQKRQLEKVTRR 136
115   --------------------KQFLRNIPRLAVLLRPLRLLILVRILQLAHQKRQLEKLTRQ 136
116   --------------------KHFLRDIPRLAVLLRPLRLLILIRILQLAHQKRQLERLTRK 136
117   --------------------FKFLKTIPRLTILFRPLRLIILIRVFHLAHQKRHLEMLTRR 140
118   --------------------IKLLRNIPRWTHLVRLLRLIILIRIFHLLHQKRQLEKLMRR 136
119   --------------------IKLLRNIPRWTHLLRLLRLIILLRIFHLFHQKRQLEKLIRR 136
```

Figure 30H

```
120         --------------------VQETGADGLGRLVVLARLLRVVRLARIFYSHQQMKASSRR 137
121         ------------------------LGLFRLVRLLRFLRILLIISRGSKFLSAIAD--- 124
122         ------------------------LRFLRALRLIQFSEILQFLNILKTSNSIK-------- 133
123         ------------------------LRFLRALRLIQFSEILQFLNILKTSNSIK-------- 133

001         KQ----- 141
002         KQ----- 141
003         KL----- 141
004         KQ----- 141
005         KQ----- 141
006         KQ----- 141
007         KQ----- 141
008         KQ----- 141
009         KQ----- 141
010         KQ----- 132
011         KQ----- 141
012         KQ----- 141
013         KQ----- 141
014         KE----- 141
015         KE----- 141
016         KE----- 141
017         KE----- 141
018         KE----- 141
019         HK----- 140
020         RK----- 143
021         -------
022         SLKN--- 142
023         SLKN--- 141
024         TLPM--- 136
025         TLPM--- 136
026         SLKP--- 142
027         SVKK--- 125
028         SVKK--- 125
029         SVKK--- 125
030         SVKK--- 125
031         SVKK--- 127
032         SVKK--- 130
033         SVKK--- 130
034         SVKK--- 125
035         SVKK--- 125
036         SVKK--- 125
037         SVKK--- 125
038         SVKK--- 125
039         SVKK--- 125
040         -------
041         SVKK--- 125
042         SVKK--- 125
043         SVRK--- 122
044         CLKQ--- 125
045         AMV---- 149
046         AML---- 150
047         ALV---- 150
048         AMV---- 150
049         AMVP--- 150
050         AMV---- 138
051         AMIP--- 134
052         AMV---- 133
053         AIPA--- 128
054         AIPA--- 128
055         AIPS--- 135
056         AIPS--- 135
057         AIPS--- 135
058         ----------
```

Figure 30I

```
059          SM----- 140
060          -------
061          ALPQ--- 138
062          SLPS--- 135
063          SLPA--- 135
064          SLPS--- 136
065          TMDN--- 128
066          SFKA--- 135
067          -------
068          CYQQ--- 164
069          SFKE--- 155
070          SYNE--- 155
071          SYNE--- 155
072          SYKE--- 155
073          CYEE--- 149
074          SYHE--- 152
075          SYRE--- 172
076          CTRE--- 166
077          CTRE--- 163
078          STNE--- 171
079          STNE--- 166
080          SAKE--- 168
081          SMRE--- 172
082          SMRE--- 216
083          SMRE--- 197
084          SMRE--- 177
085          SMRE--- 175
086          SMRE--- 184
087          SMRE--- 172
088          -------
089          SMRE--- 178
090          SMRE--- 178
091          SMRE--- 178
092          SMRE--- 182
093          CASE--- 151
094          SMKS--- 133
095          SMRS--- 132
096          SVGA---- 129
097          SVGA---- 130
098          SVGA---- 128
099          EKA----- 147
100          EKS----- 147
101          EKA----- 147
102          EKA----- 147
103          EKA----- 147
104          EKA----- 147
105          EKA----- 147
106          EKA----- 147
107          EKA----- 147
108          ECS----- 165
109          --------
110          MVSENKR 139
111          LVSENKR 143
112          MVSENKR 143
113          MVSENKR 143
114          LVSENKR 143
115          LVSGNKR 143
116          LVSGNKR 143
117          MVSGNKR 147
118          LVSENKR 143
119          RVSENKR 143
120          TISQ--- 141
121          -------
122          -------
123          -------
```

Figure 30J

>CiVSP voltage-sensor containing phosphatase [Ciona intestinalis](GenBank:
BAD98733.1) (SEQ ID NO. 195)
MEGFDGSDFSPPADLVGVDGAVMRNVVDVTINGDVTAPPKAAPRKSESVKKVHWNDVDQGPSEKPETRQE
ERIDIPEISGLWWGENEHGVDDGRMEIPTTGVGRVQFRVRAVIDHLGMRVFGVFLIFLDIILMIIDLSLP
GKSESSQSFYDGMALALSCYFMLDLGLRIFAYGPKNFFTNPWEVADGLIIVVTFVVTIFYTVLDEYVQET
GADGLGRLVVLARLLRVVRLARIFYSHQQMKASSRRTISQNKRRYRKDGFDLDLTYVTDHVIAMSFPSSG
RQSLFRNPIGEVSRFFKTKHPDKFRIYNLCSERGYDETKFDNHVYRVMIDDHNVPTLVDLLKFIDDAKVW
MTSDPDHVIAIHCKGGKGRTGTLVSSWLLEDGKFDTAKEALEYFGSRRTDFEVGDVFQGVETASQIRYVG
YFEKIKKNYGGQLPPMKKLKVTGVTITAIQGVGRGNGSDLSMQIVSERQEVLLCKFAEGYNCALQYDATD
DCVTCEVKNCPVLAGDIKVRFMSTSKSLPRGYDNCPFYFWFNTSLVEGDHVTLKREEIDNPHKKKTWKIY
RDNFTVKLTFSDAEDI >DrVSP voltage-sensing phosphoinositide phosphatase [Danio rerio] GenBank:
BAG50379.1 (SEQ ID NO. 196)
MTSVHFNPGLDSKEVGNSVKEEAEVQIGDGKEETKDPDTMYHQVRKKITPFVMSFGFRVFGLVLIILDI
IMVIVDLSLSEKSRDVGGALETVSLVISFFFLIDVLLRVYVEGFKVYFSSKLNIVDACIVVITLVVTMIY
AFSDFSGASLIPRVVTFLRSLRILILVRIFRLASQKRELEKVTRRMVSENKRRYQKDGFDLDLTYVTERV
IAMSFPSSGKQALYRNPIREVVRFLDTKHMDHYKVFNLCSEKGYDPKFFHYRVERVMIDDHNVPSLDDML
RYTACVRDWMAADSRNVIAIHCKGGKGRTGTMVCTWLIDSDQFESAQESLDYFGERRTDKSMSSKFQGVE
TPSQSRYVGYYEIMKNQYNRQLPPRKSLKIKSIRIHSIAGVGKGNGSDLKLKIIVKHELVFQCVCAKQHN
CTVFPDTGSNAVVISLQDGPIVTGDVKVMFESSAGLPKGYEDCPFYFWFNTSFVENYRLFLSREELDNPH
KPKTWDIYKEDFGVTLSFTEP >TPIP alpha lipid phosphatase [Homo sapiens] GenBank: CAD13144.1 (SEQ ID NO.
197)
MNESPQTNEFKGTTEEAPAKESPHTSEFKGAALVSPISKRIFGVFLVLLDVTLLLADLIFTDSKLYIPLE
YRSISLAIGLFFLMDVLLRVFVEGWTHLVRLLRLIILIRIFHLLHQKRQLEKLMRRLVSENKRRYTRDGF
DLDLTYVTERIIAMSFPSSGRQSFYRNPIEEVVRFLDKKHRNHYRVYNLCSERAYDPKHFHNRVSRIMID
DHNVPTLHEMVVFTKEVNEWMAQDLENIVAIHCKGGKGRTGTMVCALLIASEIFLTAEESLYYFGERRTN
KTHSNKFQGVETPSQNRYVGYFAQVKHLYNWNLPPRRILFIKRFIIYSIRGDVCDLKVQVVMEKKVVFSS
TSLGNCSILHDIETDKVLINVYDGPPLYDDVKVQFFSSNLPKYYDNCPFFFWFNTSFIQNNRLCLPRNEL
DNPHKQKAWKIYPPEFAVEILFGKK >TPTE2 Phosphatidylinositol-3,4,5-trisphosphate 3-phosphatase [Homo sapiens]
Uniprot: Q6XPS3 (SE QID NO: 198)
MNESPQTNEFKGTTEEAPAKESPHTSEFKGAALVSPISKSMLERLSKFEVEDAENVASYD
SKIKKIVHSIVSSFAFGIFGVFLVLLDVTLLLADLIFTDSKLYIPLEYRSISLAIGLFFL
MDVLLRVFVEGRQQYFSDLFNILDTAIIVIPLLVDVIYIFFDIKLLRNIPRWTHLVRLLR
LIILIRIFHLLHQKRQLEKLMRRLVSENKRRYTRDGFDLDLTYVTERIIAMSFPSSGRQS
FYRNPIEEVVRFLDKKHRNHYRVYNLCSERAYDPKHFHNRVSRIMIDDHNVPTLHEMVVF
TKEVNEWMAQDLENIVAIHCKGGKGRTGTMVCALLIASEIFLTAEESLYYFGERRTNKTH
SNKFQGVETPSQNRYVGYFAQVKHLYNWNLPPRRILFIKRFIIYSIRGDVCDLKVQVVME
KKVVFSSTSLGNCSILHDIETDKILINVYDGPPLYDDVKVQFFSSNLPKYYDNCPFFFWF
NTSFIQNNRLCLPRNELDNPHKQKAWKIYPPEFAVEILFGEK

Figure 31

```
hKv2.1    ---MPAGMTKHGSRSTSSLPPEPMEIVRSKACSRR-VRLNVGGLAHEVLWRTLDRLPRTRL  57
CiVSP     ------------------------------------------------------------
DrVSP     ------------------------------------------------------------
TPIP      ------------------------------------------------------------
TPTE2     ------------------------------------------------------------ hKv2.1    GKLRDCNTHDSLLEVCDDYSLDDNEYFFDRHPGAFTSILNFYRTGRLHMMEEMCALSFSQ  117
CiVSP     ---------------------------------------------MEGFDGSDFSP    11
DrVSP     ------------------------------------------------MTSVHFNP     8
TPIP      ---------------------------------------------------MNE       3
TPTE2     ---------------------------------------------------MNE       3 hKv2.1    ELDYWGIDEIYLESCCQARYHQKKEQMNEELKREAETLREREGEEFDN------------  165
CiVSP     PADLVGVDGAVMRNVVDVTINGDVTAPPKAAPRKSESVKKVHWNDVDQGPSEKPETRQEE  71
DrVSP     GLDSKEVNGNSVKEEAEVQI-GDGKEETKDPDTMYHQVR---------------------  46
TPIP      SPQTNEFKG--TTEEAPAKE-SPHTSEFKGAALVSPISK---------------------  39
TPTE2     SPQTNEFKG--TTEEAPAKE-SPHTSEFKGAALVSPISKSMLE-----------------  43 hKv2.1    ---------------TCCAEKRKKLWDLLEKPNSSVAAKILAIISIMFIVLSTIALSLNTL  211
CiVSP     RIDIPEISGLWWGENEHGVDEGRMEIPTTGVGRVQFRVPAVIDHLGMRVFGVFLIFLDII  131
DrVSP     ----------------------KKITPFVMSFGFRVFGLVLIILDII              71
TPIP      ------------------------------RIFGVFLVLLDVT                   52
TPTE      -------------RLSKFEVEDAENVASYDSKIKKIVHSIVSSFAFGLFGVFLVLLDVT   89
TPTE2     -------------RLSKFEVEDAENVASYDSKIKKIVHSIVSSFAFGIFGVFLVLLDVT   89 hKv2.1    PELQSLDEFGQSTDNPQLAHVEAVCIAWFTMEYLLRFLSSPKKWKFFKGPLNAIDLLAIL  271
CiVSP     LMIIDLSLPGKSESSQSFYDGMALALSCYFMLDLGLRIFAYGPKNFFTNPWEVADGLIIV  191
DrVSP     MVIVDLSLSEKSRDVGGALETVSLVISFFFLIDVLLRVYVEGFKVYFSSKLNIVDACIVV  131
TPIP      LLLADLIFTDSKLYIPLEYRSISLAIGLFFLMDVLLRVFVEG------------------  94
TPTE2     LLLADLIFTDSKLYIPLEYRSISLAIGLFFLMDVLLRVFVEGRQQYFSDLFNILDTAIIV  149 hKv2.1    PYYVTIFLTESNKSVLQFQNVRRVVQIFRIMRILRILKLARHSTGLQSLGFTLRRSYNEL  331
CiVSP     VTFVVTIFYTVLDEYVQETGADGLGRLVVLARLLRVVRLARIFY----------------  235
DrVSP     ITLVVTMIYAFSDFSGASL-IPRVVTFLRSLRILILVRIFRLAS----------------  174
TPIP      ---------------------WTHLVRLLRLIILIRIFHLLH-----------------  115
TPTE2     IPLLVDVIYFFDIRLLRN-IPRWTHLVRLLRLIILIRIFHLLH----------------  192 hKv2.1    GLLILFLAMGIMIFSSLVFFAEKDEDDTKFKSIPASFWWATITMTTVGYGDIYPKTLLGK  391
CiVSP     ------------------------------------------------------------
DrVSP     ------------------------------------------------------------
TPIP      ------------------------------------------------------------
TPTE2     ------------------------------------------------------------
```

Figure 32A

```
hKv2.1  IVGGLCCIAGVLVIALPIPIIVNNFSEFYKEQKRQEKAIKRREALERAKRNGSIVSMNMK  451
CiVSP   ------------------------------SHQQMKASSRRTISQNKRR----------  254
DrVSP   ------------------------------QKRELEKVTRRMVSENKRR----------  193
TPIP    ------------------------------QKRQLEKLMRRLVSENKRR----------  134
TPTE2   ------------------------------QKRQLEKLMRRLVSENKRR----------  211
                                      .                ..

hKv2.1  DAFARSIEMMDIVVEKNGENMGKKDKVQDNHLSPNKWKWTKRTLSETSSSKSFETKEQGS  511
CiVSP   ------------------------------YRKDGFDLDLTYVTDHVIAMSFPS-----  278
DrVSP   ------------------------------YQKDGFDLDLTYVTERVIAMSFPS-----  217
TPIP    ------------------------------YTRDGFDLDLTYVTERIIAMSFPS-----  158
TPTE2   ------------------------------YTRDGFDLDLTYVTERIIAMSFPS-----  235
                                          ::     :.

hKv2.1  PEKAPSSSPQHLNVQQLEDMYNKMAKTQSQPILNTKESAAQSKPKEELEMESIPSPVAP  571
CiVSP   --------SGRQSLFRNPIGEVSRFFKTKHPDKFRIYNLCSEPGYDETKFDNH-------  323
DrVSP   --------SGKQALYRNPIREVVRFLDTKHMDHYKVFNLCSEKGYDPKFFHYR-------  262
TPIP    --------SGRQSFYRNPIEEVVRFLDKKHRNHYRVYNLCSERAYDPKHFHNR-------  203
TPTE2   --------SGRQSFYRNPIEEVVRFLDKKHRNHYRVYNLCSERAYDPKHFHNR-------  280
                : ::   :   :.    .:          .  :

hKv2.1  LPTRTEGVIDMRSMSSIDSFISCATDFPEATRFSHSPLTSLPSKTGGSTAPEVGWRGALG  631
CiVSP   ---VYRVMIDDHNVPTLVDLLKFIDDAKVWMTSDPDHVIAIHCKGG--------KGRTG  371
DrVSP   ---VERVMIDDHNVPSLDDMLRYTACVRDWMAADSRNVIAIHCKGG--------KGRTG  310
TPIP    ---VSRIMIDDHNVPTLHEMVVFTKEVNEWMAQDLENIVAIHCKGG--------KGRTG  251
TPTE2   ---VSRIMIDDHNVPTLHEMVVFTKEVNEWMAQDLENIVAIHCKGG--------KGRTG  328
           .  ..  ..   .                   : ::            .

hKv2.1  ASGGRFVEANPSPDASQHSSFFIESPKSSMKTNNPLKLRALKVNFMEGDPSPLLPVLGMY  691
CiVSP   TLVSSWLLEDGKFDTAKEALEYFGSRBTDFEVGD---------VFQGVETASQIRYVGYF  422
DrVSP   TMVCTWLIDSDQFESAQESLDYFGERRTDKSMSS---------KFQGVETPSQSRYVGYY  361
TPIP    TMVCALLIASEIFLTAEEESLYYFGERRTNKTHSN--------KFQGVETPSQNRYVGYF  302
TPTE2   TMVCALLIASEIFLTAEEESLYYFGERRTNKTHSN--------KFQGVETPSQNRYVGYF  379
          :              ..   :      .     *    . .

Shaker  GQHMKKSSLSESSSDMMDLDDGVESTPGLTETHPGRSAVAPFLG---AQQQQQQQFVASS  569
hKv2.1  HDPLRNRGSAAAAVAGLECATLLDKAVLSPESSIYTTASAKTPPRSPEKHTAIAFNFEAG  751
CiVSP   EKIKKNYGGQLPPMKKLKVTGVTITAIQGVGRGNGSDLSMQIVS---ERQEVLLCKFAEG  479
DrVSP   EIMKNQYNRQLPPRKSLKIKSIRIHSIAGVGKGNGSDLKLKIIV---KHELVFQCVCAKQ  418
TPIP    AQVKHLYNWNLPPRRILFIKRFIIYSIR-----GDVCDLKVQVVM---EKKVVFSSTSLG-  354
TPTE2   AQVKHLYNWNLPPRRILFIKRFIIYSIR-----GDVCDLKVQVVM---EKKVVFSSTSLG-  431
           .   ..   :        :                            :.

Shaker  LSMSIDKQLQHPLQHVTQTQLYQ------QQQQQQQQQNGFKQQQQQTQQQLQQQQSHTI  624
hKv2.1  VHQYIDADTDDEGQLLYSVDSSPPKSLPGSTSPKFSTGTRSEKNHFESSPLP--TSPKFL  809
CiVSP   YNCALQYDATDDCVTCEVKNCPV---LAGDIKVRFMSTSKSLPRGYDNCPFYFWFNTSLV  536
DrVSP   HNCTVFPDTGSNAVVISLQDGPI---VTGDVKVMFESSAG-LPKGYEDCPFYFWFNTSFV  474
TPIP    -NCSILHDIETDKVLINVYDGPP----LYDDVKVQFFSSN---LPKYYDNCPFFFWFNTSFI  408
TPTE2   -NCSILHDIETDKILINVYDGPP----LYDDVKVQFFSSN---LPKYYDNCPFFFWFNTSFI  485
          :  :               .     .                 :          .  :
```

Figure 32B

```
Shaker    NASAAAATSGSGSSGLTMRHNNALAVSIETDV----------------- 656
hKv2.1    RQNCIYSTEALTGKGPSGQEKCKLENHISPDVRVLPGGGAHGSTRDQSI 858
CiVSP     EGDHVTLKREEIDNPHKKKTWKIYRDNFTVKLTFSDAEDI--------- 576
DrVSP     ENYRLFLSREELDNPHKPKTWDIYKEDFGVTLSFTEP------------ 511
TPIP      QNNRLCLPRNELDNPHKQKAWKIYPPEFAVEILFGKK------------ 445
TPTE2     QNNRLCLPRNELDNPHKQKAWKIYPPEFAVEIL---------------- 518
                    .,  . :           :   :
```

Figure 32C

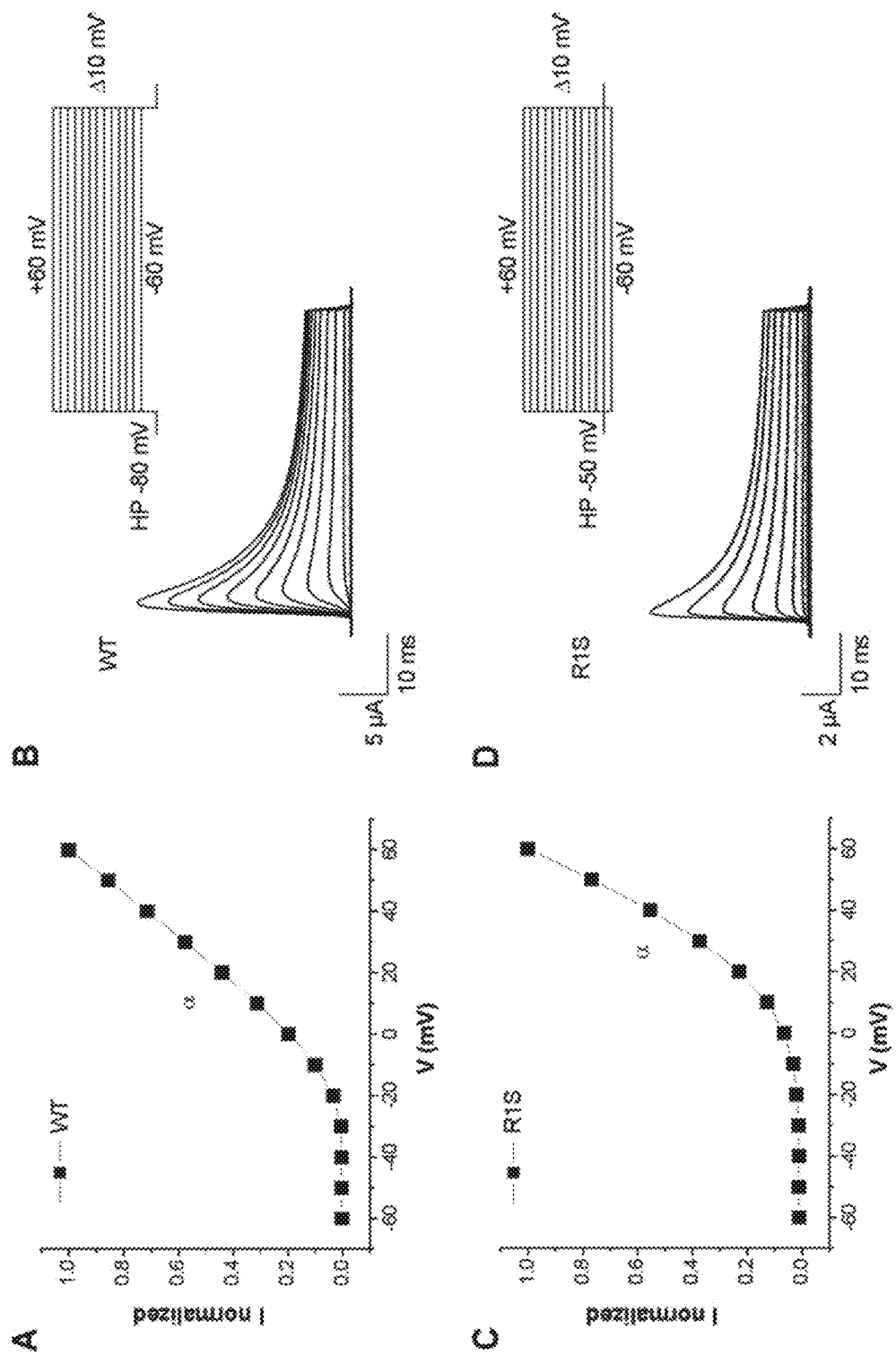
Figures 33A-D

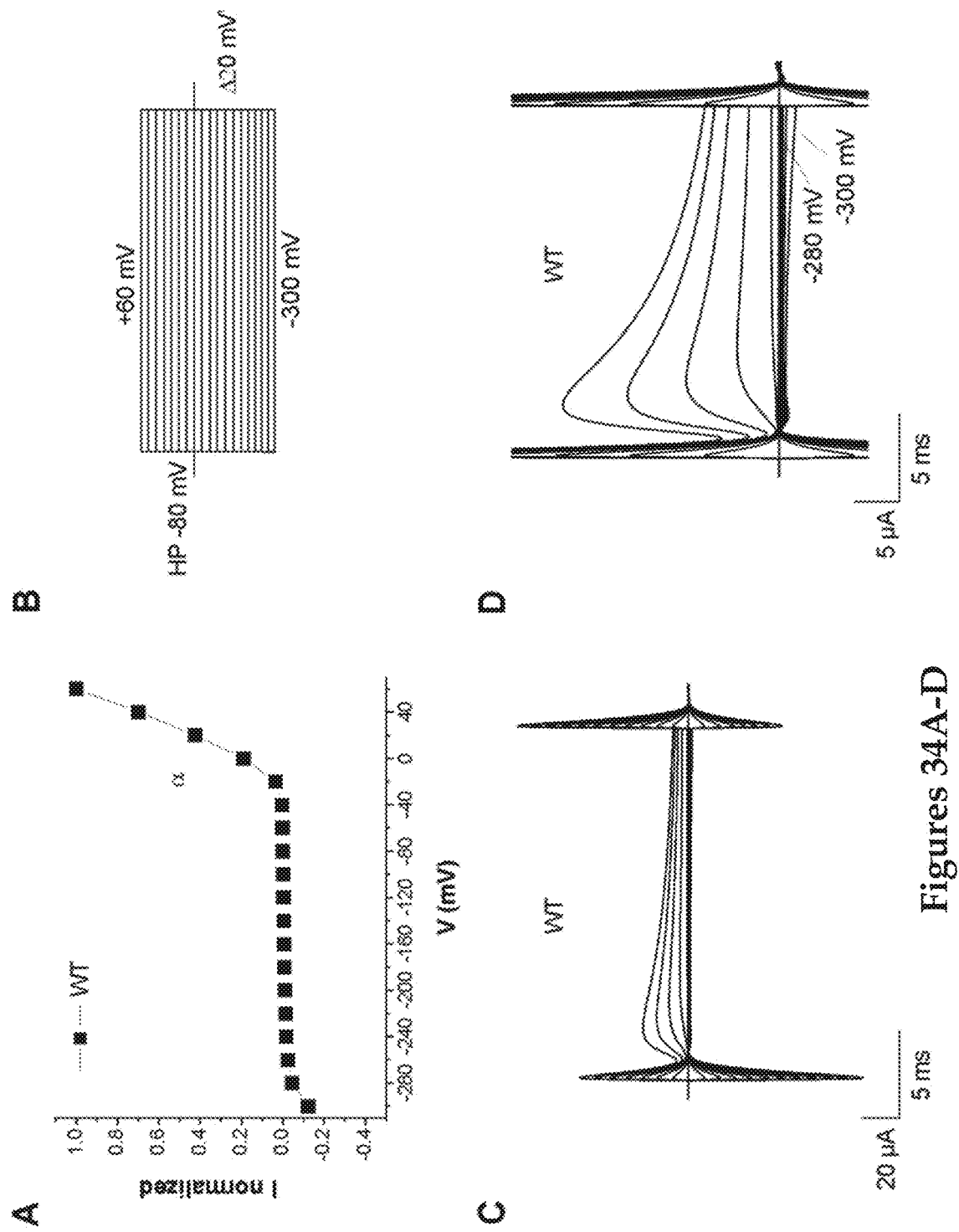
Figures 34A-D

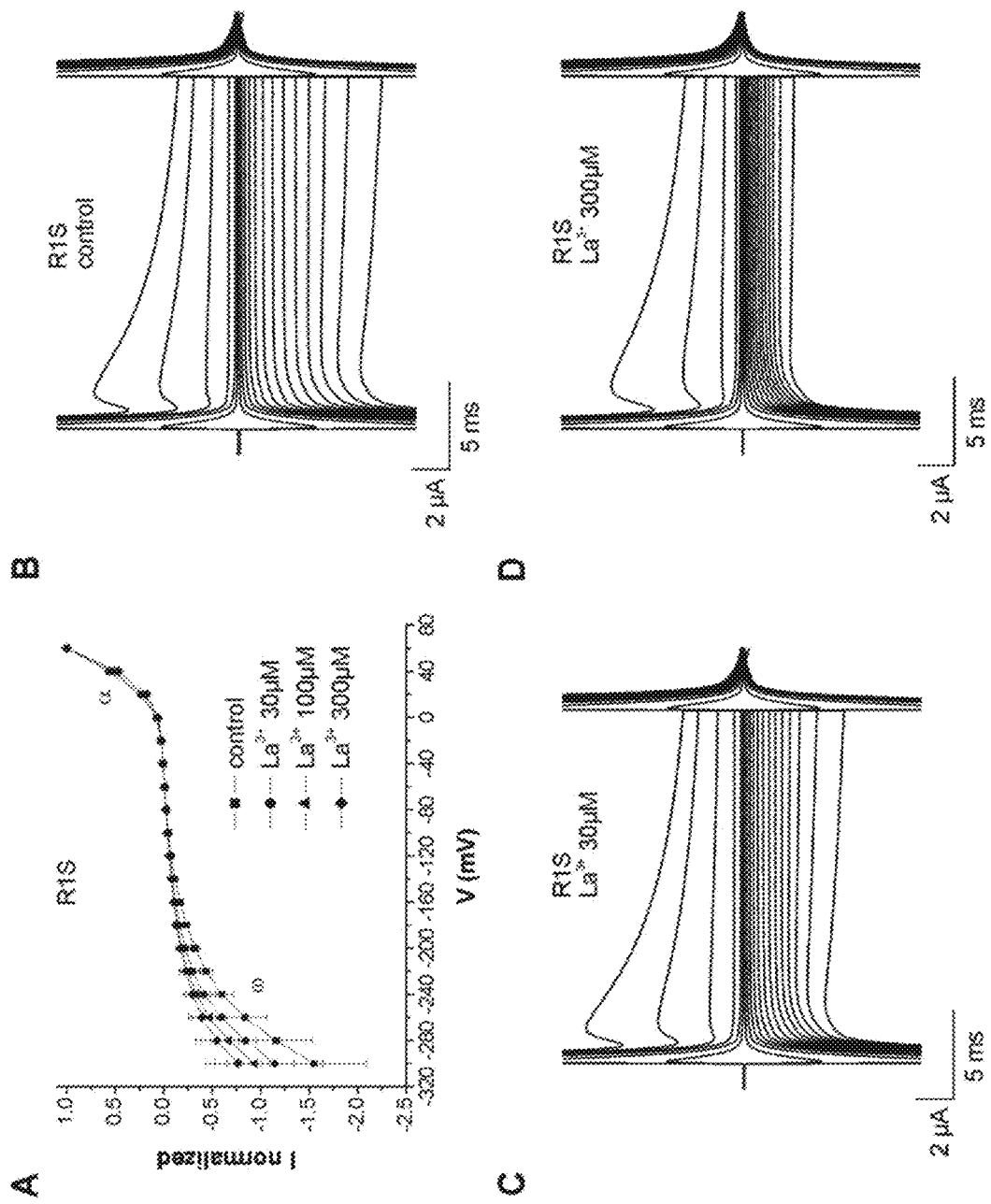
Figures 35A-D

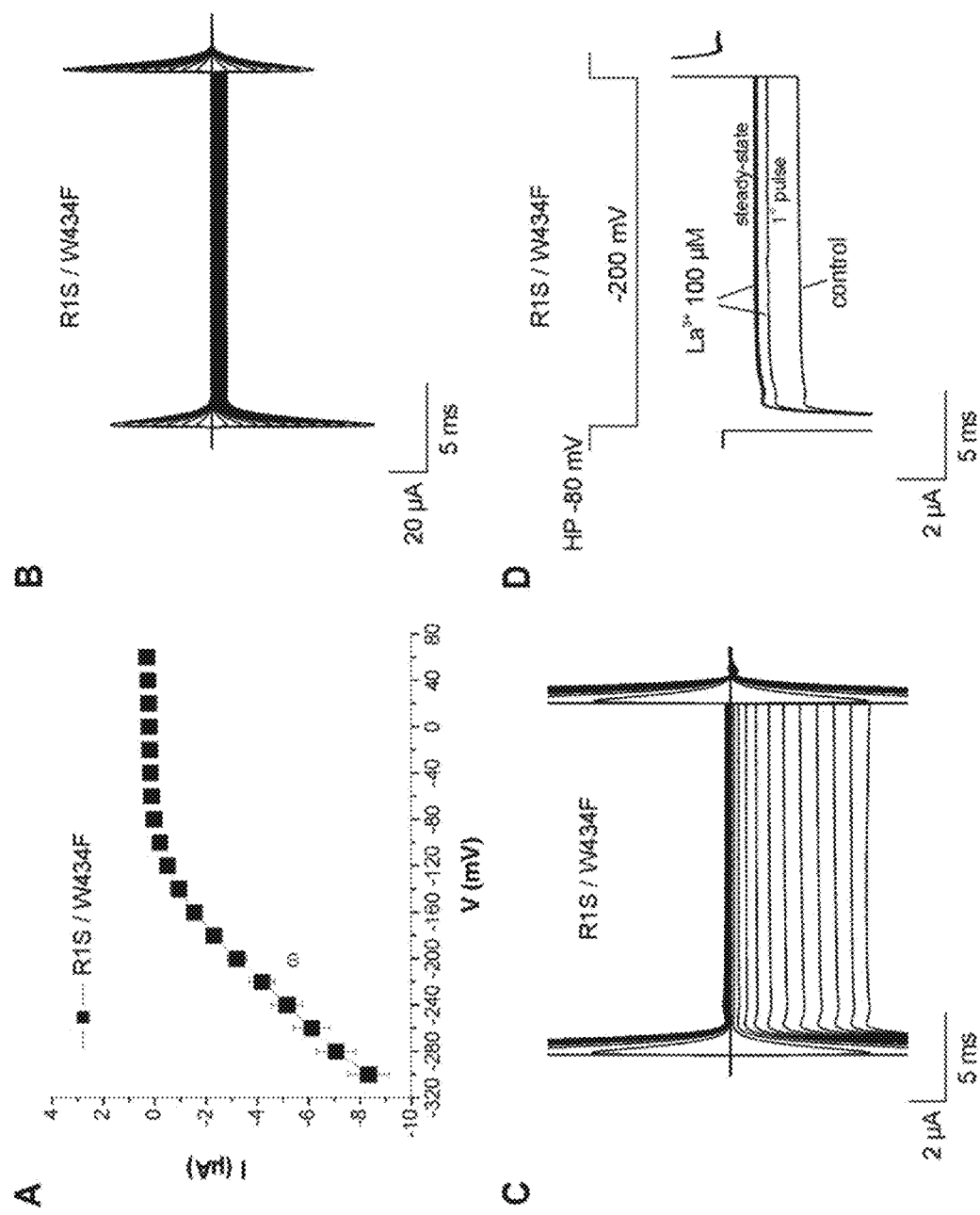
Figures 36A-D

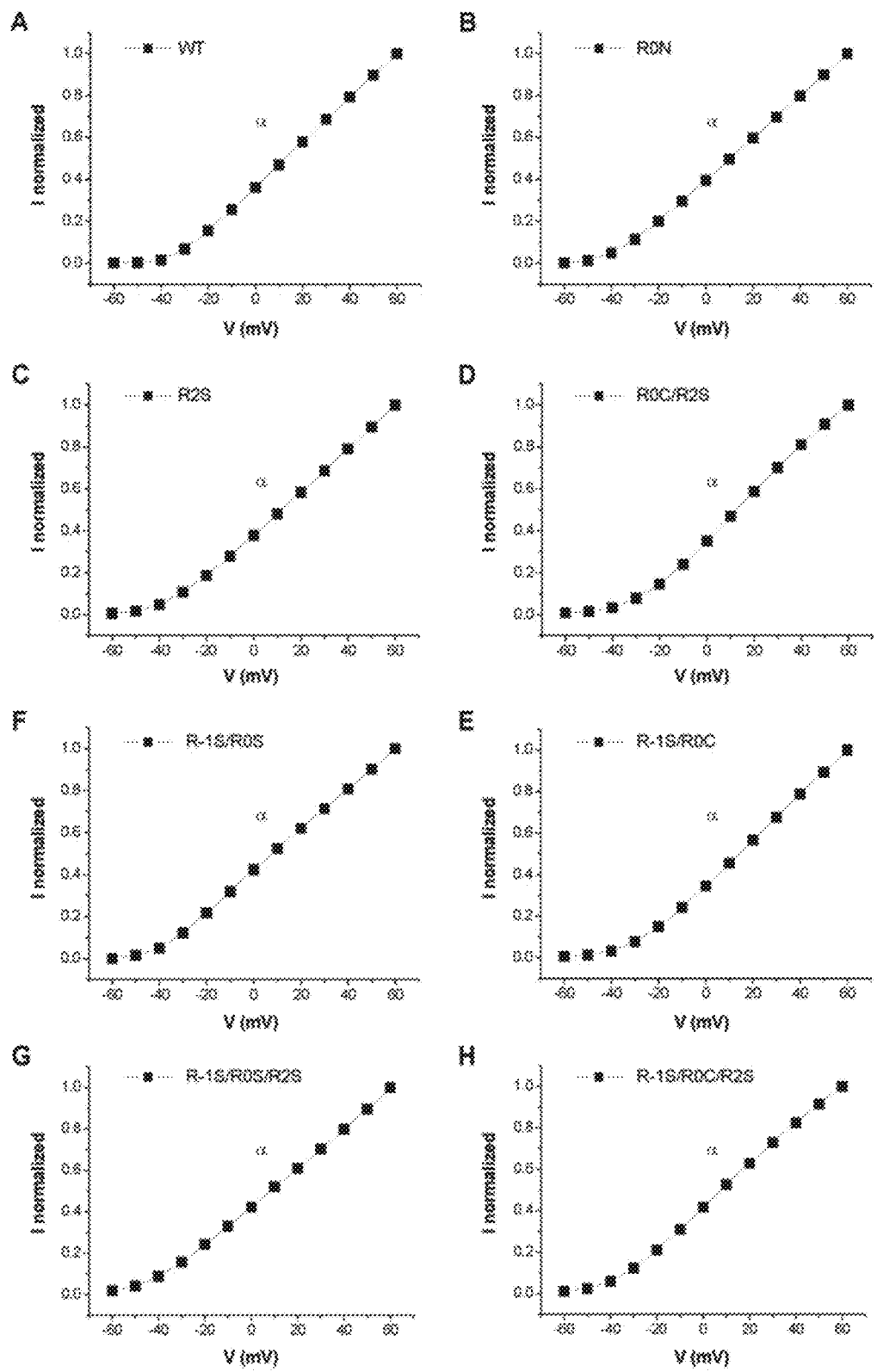
Figures 37A-H

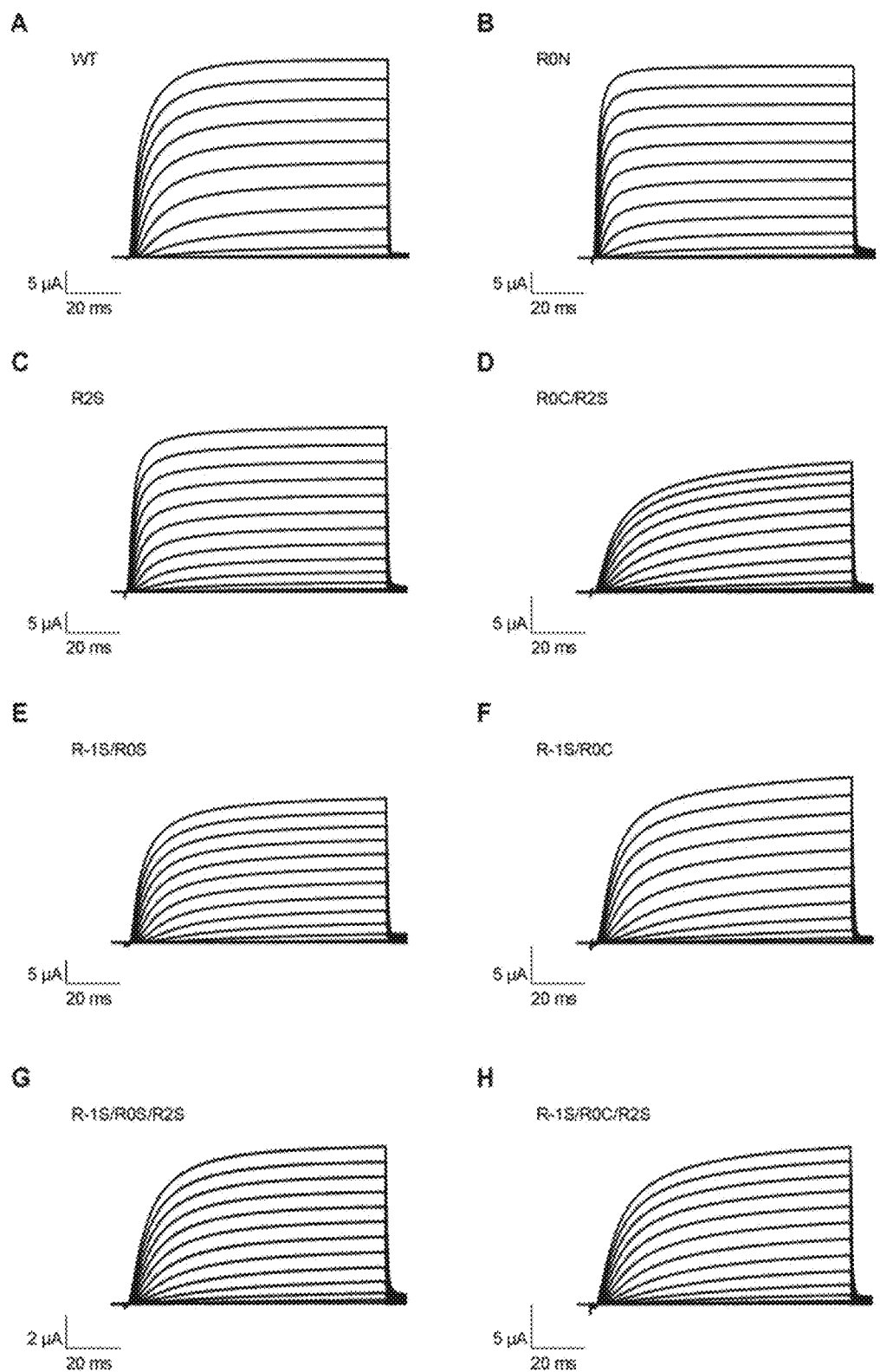
Figures 38A-H

Figures 40A-F

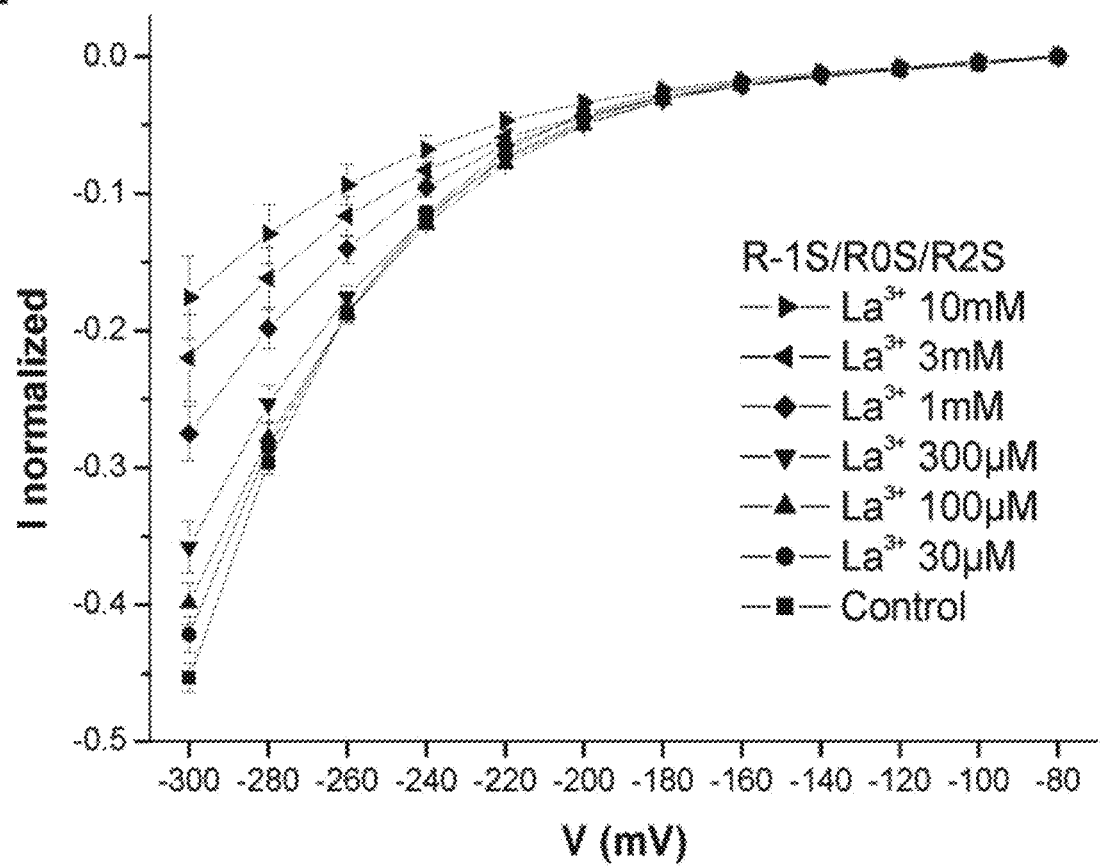
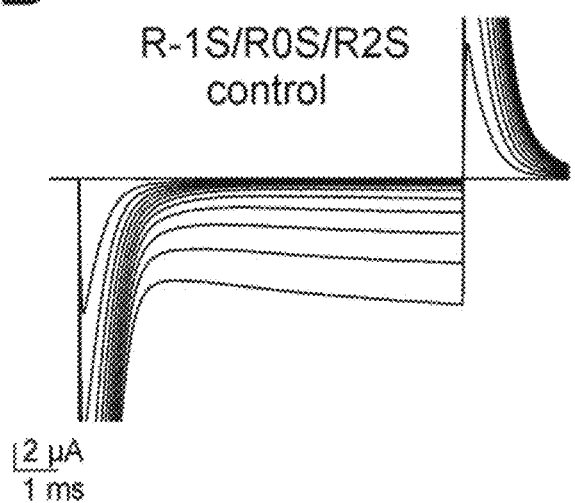
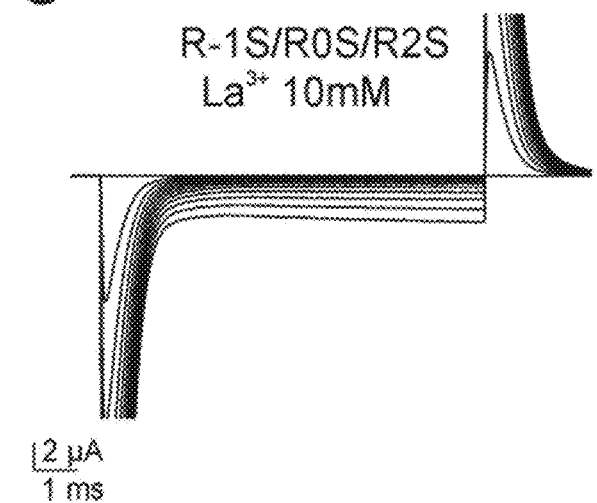
Figures 43A-C

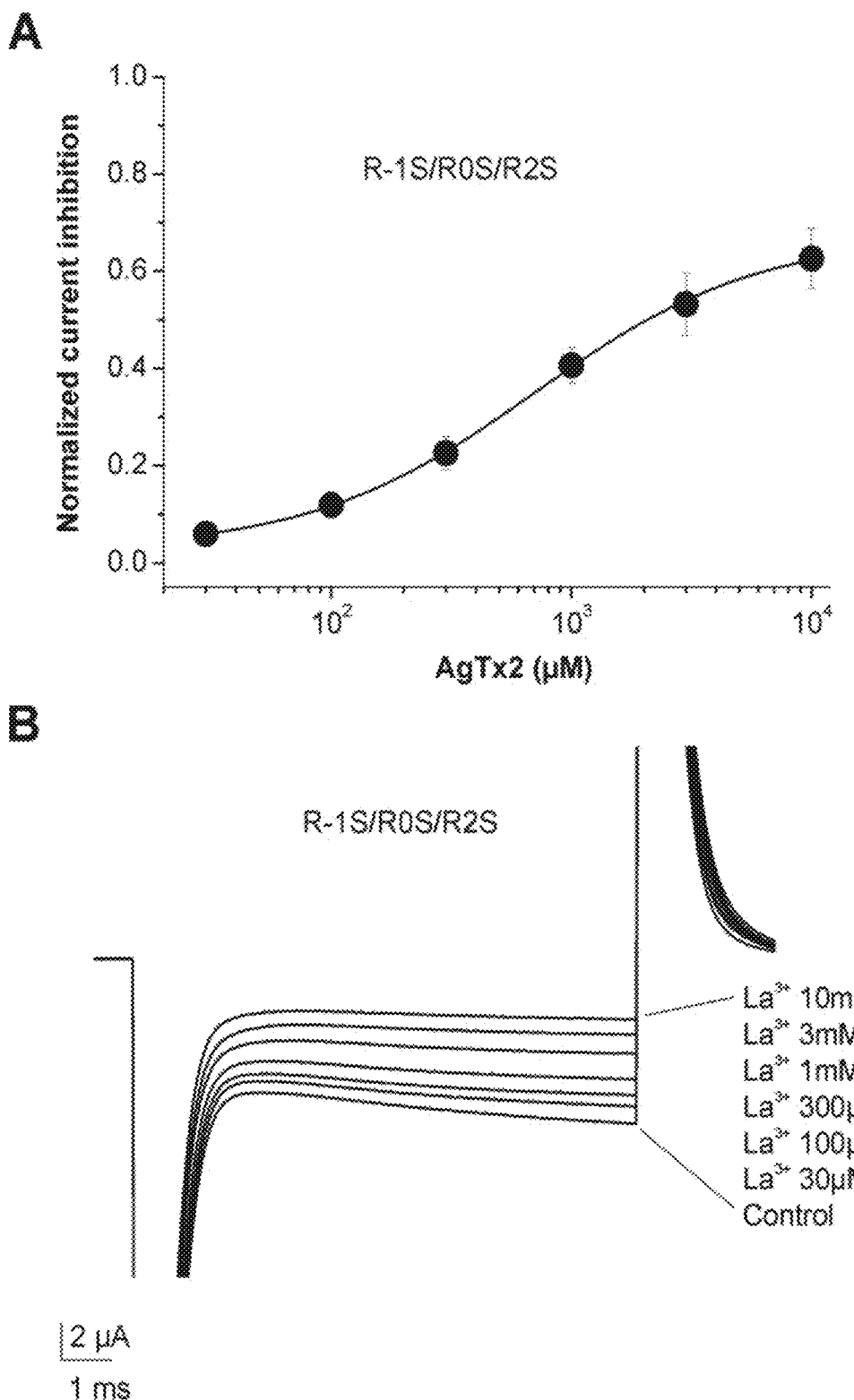
Figures 44A-B

```
Shaker :  SLATLVL VE IF LS HSKGLQILG  :386
Kv2.1 :   V  VV IM IL LA HSTGLQSLG   :321
          R-1 R0  R1
          293 294 300
```

Figure 48

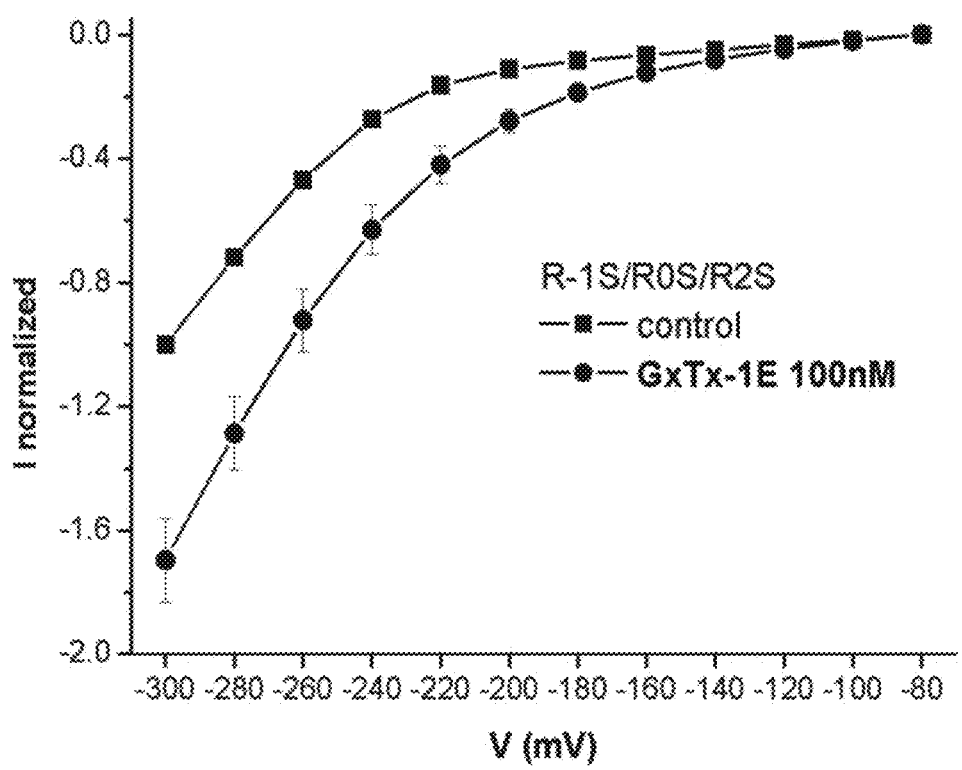
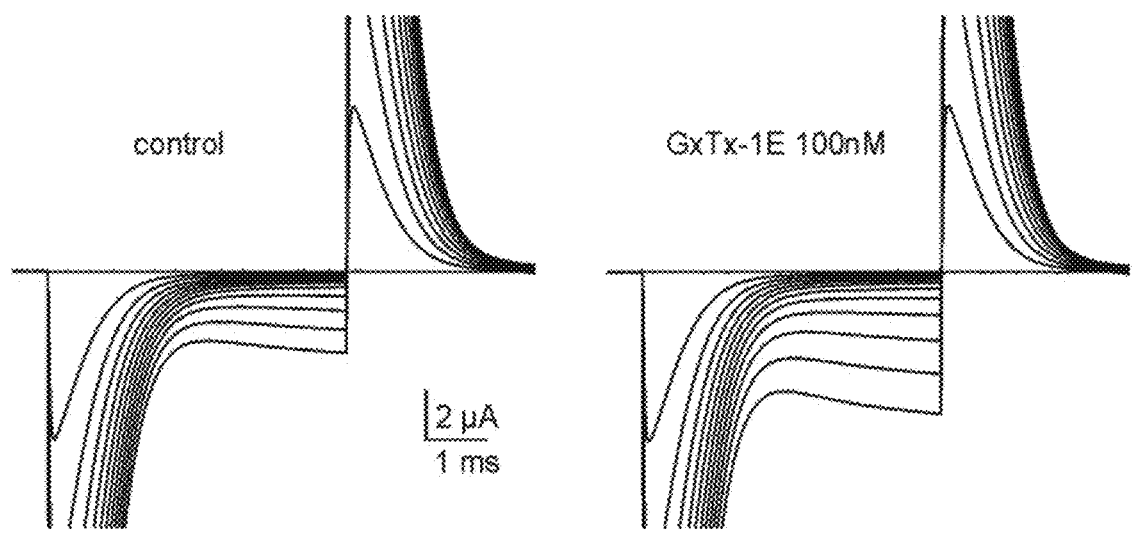
Figures 49A-B

| | | | |
|---|---|---|---|
| Shaker | 1 | MAAVAGLYGLGEDRQHRKKQQQQQQHQKEQLEQKKIAERKLQLREQQLQRNSLDGYGSLPKLSSQDEEGGAGHGFG | 80 |
| Kv2.1 | 1 | MPAGMTKHG--------------------------------------------------SRST----SSLP--- | 17 |
| CiVSP | | | |
| DrVSP | | | |
| TPIP | | | |
| TPTE2 | | | |
| | | | |
| Shaker | 81 | GGPQHFEPIPHDHDFCERVVINVSGLRFETQLRTLNQFPDTLLGDPARR-----------LRVEDPLRNEYFDRSRPSEDA | 151 |
| Kv2.1 | 18 | --PEPME-IVRSKACSRRVRLNVGGLAHEVLWRTLDRLPRTRLGKLRDCNTHDSLLEVCDDYSLDDNEYFFDRHPGAFTS | 94 |
| CiVSP | | | |
| DrVSP | | | |
| TPIP | | | |
| TPTE2 | | | |
| | | | |
| Shaker | 152 | ILYYQSGGRLRRPVNVPLDVFSEEIKFYELG--------DQAINKF-------REDEGF-------I | 197 |
| Kv2.1 | 95 | ILNFYRTG-RLHMMEEMCALSFSQELDYWGID--------EIYLESCCQARY--HQKKEQM-------NEELK | 149 |
| CiVSP | 1 | ---------NEGFDGSGFSPPADLVGVDGAVMRNVVDVTINGDVTAPPKAAPRKSESVKKVHWNDVDQGPSEKPET | 67 |
| DrVSP | 1 | ---------------------------------MTSVHEN-----------PGLDSKEV-----NGNS----V | 20 |
| TPIP | 1 | ---------------------------------MN---------ESPQTNEF-------KGTTEEAPA | 19 |
| TPTE2 | 1 | ---------------------------------MN---------ESPQTNEF-------KGTTEEAPA | 19 |

Figure 53A

```
Shaker  198  KEEERPLP----------------------DN----EKQRKVWL-LFEYPE------------SSQAARVVAIISVF-VILLSIVIF   244
Kv2.1   150  REAETLRERE--------GE----EFDNTCCAEKRKKLWD-LLEKPN------------SSVAAKTLAIISIM-FIVLSTIAL   206
CiVSP    68  RQEERIDIPEISGLWWGENEHGVDDGRMEIPTTGVG----------------RVQFRVRAVIDHLGMRVFGVELI   126
DrVSP    21  KEEAEVQ-----------IGDG-----------KEETKDPDTMYH---QVRKKIPEVMSFGERVEGLVLI    66
TPIP     20  KESPHTS----------------------------------EFKGAALVSPISKR-----------------------IFGVFLV    47
TPTE2    20  KESPHTS----------------------------------EFKGAALVSPISKMERLSKEVEDAENVASYDSKIKKIVHSIVSSFAEGIFGVELV    84

Shaker  245  CLETLPEFKHYKVFNTTNGTKIEEDEVPDITDPFFLIETLCIIWFTEFTVRFLACPNKLNFCRDVMNVID-IIAIIPY   323
Kv2.1   207  SINTLPELQSLDEFGQSTDNPQLAH-------------------VEAVCIAWFTMEYLLRFLSSPKKWKFFKGPLNAID-LLAILPY   273
CiVSP   127  FLDIILMIIDLSLPGKSE-------------------SSQSFYDGMALASCYEMDLGLRIFAYGPK-NFFTNFWEVADGLIIVTF   194
DrVSP    67  ILDIIMIVIDLSISEKSR---------------------DVGGALETVSLVISFFELIDVLLRVVVEGFK-VFFSSKLNIVDACIVITL   134
TPIP     48  LLDVTLLLADLIFTDSKL---------------------YIPLEYRSISLAIGLFFLMDVLLRVFVEG----------------   94
TPTE2    85  LLDVTLLLADLIFTDSKL---------------------YIPLEYRSISLAIGLFFLMDVLLRVFVEGRQ-QVFSDLFNILDTAIIVIPL   152

Shaker  324  FITLATVAEEEDTINLPKAPVSPQDKSSNQAMSLAILRVIRLVRVFRIFKLSRHSKGLQILGRTLKASMRE------------   395
Kv2.1   274  YVTIFLTESNKS--VLQF-------------------QNVRRVVQIFRIMRILRILKLARHSTGLQSLGFTLRRSYNE-----------   330
CiVSP   195  VVTIFYTVLDEY-V---------------------QETGADGLGRIVVLARLLRVVRLARIFY---SHQQMKASSRRTISQNKRRYRKD   258
DrVSP   135  VVTMIYAFSDF----------------------SGASLIPRVVFTFLRSIRILLLVRIFRLASQKRELEKVIRRMVSENKRRYQKD   197
TPIP     95  ------------------------------WTHLVRLRILLIRIFHLLHQKRQELKLMRRLVSENKRRYTRD   138
TPTE2   153  LVDVIYIFFDI------------KLLRNIPRWTHLVRLILLIRLILIRIFHLLHQKRQELKLMRRLVSENKRRYTRD   215
```

Figure 53A cont.

```
Shaker  396  ------LGLLIFLFIGVVLFSSAVYF--------------------------------------AEAGSENSFFK------------SIPDAF  433
Kv2.1   331  ------LGLILFLAMGIMFSSLVFF--------------------------------------------AEKDEDTKFK------------SIPASF  368
CiVSP   259  GFDLDLTYVTDHVIAMSFPSSGRQSLFRNPIGEVSRFFKTKHPDKFRIYNLCSERGIDETKFDNHVYRVMIDDHNVPTLV  338
DrVSP   198  GFDLDLTYVTERVIAMSFPSSGRQALYRNPIREVVRFLDTKHMDHYKVFNLCSEKGYDPKFFHYRVMIDDHNVPSLD  277
TPIP    139  GFDLDLTYVTERIIAMSFPSSGRQSFYRNPIEEVVRFLDKKHRNHYRVNLCSERAYDPKHFNRVSRIMIDDHNVPTLH  218
TPTE2   216  GFDLDLTYVTERIIAMSFPSSGRQSFYRNPIEEVVRFLDKKHRNHYRVNLCSERAYDPKHFNRVSRIMIDDHNVPTLH  295

Shaker  434  WWAVVTMTTVGYGDMTPVGVWGKIVGSLCAIAGVLTIALPVP---VIVSNFNYFYHRETDQEEMQSQNFNHVTSCPYLPG  510
Kv2.1   369  WWATITMTTVGYGDIYPKTLLGKIVGGLCCIAGVLVIALPIP---IIVNNFSEFYKEQRQEKAIKRRE--ALERAKRNG  443
CiVSP   339  DLLKFIDDAKVWMTSDPDHVIAIHCKGGKGRTGTLVSSWLLEDGKFDTAKEALEYFGSRRTDFEVGDVFQ-GVETASQIR  417
DrVSP   278  DMLRYTACVRDWMAADSRNVIAIHCKGGKGRTGTMVCTWLIDSDQFESAQESLDYFGERRTDKSMSSKFQ-GVETPSQSR  356
TPIP    219  EMVVFTKEVNEWMAQDLENIVAIHCKGGKGRTGTMVCALLIASEFLTAEESLYYFGERRTNKTHSNKFQ-GVETPSQNR  297
TPTE2   296  EMVVFTKEVNEWMAQDLENIVAIHCKGGKGRTGTMVCALLIASEFLTAEESLYYFGERRTNKTHSNKFQ-GVETPSQNR  374

Shaker  511  TL--------------------GQHMK-KSSLSESSSDNMDLDDGVESTPGLITETHPGSAVAPLGAQQQQQQQ  564
Kv2.1   444  SIVSMNMKDAFARSIEMMDIVEKNGENMGKKDKVQDNHLSPNKWKWTKRTLSETSSSKSFETKEQGSPEKARSSSSPQH  523
CiVSP   418  YV--------------------GYFEKIKKNYGGQLPPMKKL--KVTGVITATQGVGRGNG--------SDLSMQ  463
DrVSP   357  YV--------------------GYFEIMKNQVNRQLPPRKSL--KIKSIRIHTAGVGKGNG--------SDLKIK  402
TPIP    298  YV--------------------GYFAQVKHLYNWNLPPRRIL--FIKRFIIYSI------RGDV------CDLKVQ  339
TPTE2   375  YV--------------------GYFAQVKHLYNWNLPPRRIL--FIKRFIIYSI------RGDV------CDLKVQ  416
```

Figure 53B

```
Shaker 565 PVASSLSMSIDKQLQH-------PLQHVTQT--------QLYQQQQQQQ---QQQNGFKQQQQTQQQLQQQ------ 619
Kv2.1  524 LNVQQLEDMYNKMAKTQSPILNTKESAAQSKPKEELEMESIPSPVAPLPRTEGVIDMRSMSSIDSFISCATDPPEATR 603
CiVSP  464 IVSERQEVLLCKEAEGYNCALQYDATD-------DCVTCEVKN--CPVLAGDIKVRENSTSKSLPRGVDNCPFYFWNTS 534
DrVSP  403 IIVKHELVFQCVCAKQHNCTVFPDTGS-------NAVVISLQD--GPIVTGDVKVMFES-SAGLPKGYEDCPFYFWNTS 472
TPIP   340 VVMEKKVVFSSTSLG--NCSILHDIET-------DKVLINVYD--GPPLYDDVKVQFFS-S-NLPKYDNCPFFWFNTS 406
TPTE2  417 VVMEKKVVFSSTSLG--NCSILHDIET-------DKILINVYD--GPPLYDDVKVQFFS-S-NLPKYDNCPFFWFNTS 483

Shaker 620 --QSHTINASAAATSGSGSSGLTMRHNNALAVSIETDV------------------------------------- 656
Kv2.1  604 FSHSPLTSLPSKTGGSTAPEVGWRGALGASGGRFVEANPSDASQHSSFFIESPKSSMKTNPLKLRALKVNFMEGDPSP 683
CiVSP  535 LVEGDHVTLKREEIDNPHKKTWKIYRDNFTVKLTFSDAEDI--------------------------------- 576
DrVSP  473 FVENYRLFLSREELDNPHKPKTWDIYKEDFGVTLSFTEP-------------------------------------- 511
TPIP   407 FIQNNRLCLPRNELDNPHKQKAWKIYPEFAVEILFGKK-------------------------------------- 445
TPTE2  484 FIQNNRLCLPRNELDNPHKQKAWKIYPEFAVEILFGEK-------------------------------------- 522
```

Figure 53B cont.

| | | |
|---|---|---|
| Shaker | | |
| Kv2.1 | 684 | LLPVLGMYHDPLRNRGSAAAAVAGLECATLLDKAVLSPESSIYTTASAKTPPRSPEKHTATAINFEAGVHQYIDADTDDE 763 |
| CiVSP | | |
| DrVSP | | |
| TPIP | | |
| TPTE2 | | |

| | | |
|---|---|---|
| Shaker | | |
| Kv2.1 | 764 | GQLLYSVDSSPPKSLPGSTSPKFSTGTRSEKNHFESSPLPTSPKFLRQNCIYSTEALTGKGPSGQEKCKLENHISPDVRV 843 |
| CiVSP | | |
| DrVSP | | |
| TPIP | | |
| TPTE2 | | |

| | | |
|---|---|---|
| Shaker | | |
| Kv2.1 | 844 | LPGGAHGSTRDQSI 858 |
| CiVSP | | |
| DrVSP | | |
| TPIP | | |
| TPTE2 | | |

Figure 53C

METHODS FOR SCREENING VOLTAGE-GATED PROTEINS

This application is a Divisional of U.S. application Ser. No. 14/473,386 filed Aug. 29, 2014, which is a Continuation-In-Part of International Patent Application No. PCT/US2013/028324 filed Feb. 28, 2013, which claims priority of U.S. Provisional Patent Application No. 61/604,897, filed Feb. 29, 2012, the contents of which are hereby incorporated by reference in their entirety.

This patent disclosure contains material that is subject to copyright protection. The copyright owner has no objection to the facsimile reproduction by anyone of the patent document or the patent disclosure as it appears in the U.S. Patent and Trademark Office patent file or records, but otherwise reserves any and all copyright rights.

All patents, patent applications and publications cited herein are hereby incorporated by reference in their entirety. The disclosures of these publications in their entireties are hereby incorporated by reference into this application in order to more fully describe the state of the art as known to those skilled therein as of the date of the invention described herein.

SEQUENCE LISTING

The instant application contains a Sequence Listing which has been submitted electronically in ASCII format and is hereby incorporated by reference in its entirety. Said ASCII copy, created on Dec. 5, 2016, is named 2206689.121US3_SL.txt and is 864,760 bytes in size.

BACKGROUND OF THE INVENTION

Voltage-gated ion channels are important targets for therapeutic intervention. Defects in voltage-gated ion channel function are linked to numerous biological outcomes, including, but not limited to cardiovascular, metabolic, and autoimmune disorders, pain and neurological disorders, and cancer. The identification of molecules that modulate the activity of voltage-gated proteins (hereafter, "VGPs") is difficult and relatively non-specific. There is a demand for screening methods suitable for identifying molecules that bind specifically to particular VGPs functional regions and for identifying molecules that bind specifically to particular VGP functional/conformational states. This invention addresses these needs.

SUMMARY OF THE INVENTION

In one aspect, the invention relates to a method for identifying a compound which modulates the activity of a voltage-gated ion channel, the method comprising (a) providing a voltage-gated ion channel in a structure that separates a first medium from a second medium, wherein the voltage-gated ion channel exhibits independent ion permeation, (b) contacting the voltage-gated ion channel with a test compound, (c) measuring the amount of said independent ion permeation through the voltage-gated ion channel between the first and second media, and (d) comparing the amount of said independent ion permeation measured for the voltage-gated ion channel contacted with the test compound to the amount of said independent ion permeation measured for the voltage-gated ion channel not contacted with the test compound, wherein an increase or decrease in the amount of said independent ion permeation of the voltage-gated ion channel contacted with the test compound compared to the voltage-gated ion channel not contacted with the test compound indicates that the test compound modulates the activity of the voltage-gated ion channel.

In certain embodiments, the voltage-gated ion channel comprises one or more amino acid mutations that cause the voltage gate ion channel to exhibit alpha pore independent permeation.

In one aspect, the invention relates to a method for identifying a compound which modulates the activity of a voltage-sensitive phosphatase, the method comprising (a) providing a voltage-sensitive phosphatase in a structure that separates a first medium from a second medium, (b) contacting the voltage-sensitive phosphatase with a test compound, (c) measuring the activity of the voltage-sensitive phosphatase, and (d) comparing the amount of said activity measured for the voltage-sensitive phosphatase contacted with the test compound to the amount of said activity measured for the voltage-sensitive phosphatase not contacted with the test compound, wherein an increase or decrease in the amount of activity of the voltage-sensitive phosphatase contacted with the test compound compared to the voltage-sensitive phosphatase not contacted with the test compound indicates that the test compound modulates the activity of the voltage-sensitive phosphatase.

In certain embodiments, the voltage sensitive phosphatase comprises one or more amino acid mutations that cause the voltage sensitive phosphatase to exhibit altered voltage sensitivity.

In certain embodiments the structure that separates a first medium from a second medium is polarized. In certain embodiments, the degree structure polarization is varied. In certain embodiments, the polarized structure has a voltage difference of about −300 mV to about +300 mV. In certain embodiments, the structure is a lipid bilayer. In certain embodiments, the structure is a liposome membrane. In certain embodiments, the structure comprises a naturally occurring membrane, a synthetic membrane, or any combination thereof.

In certain embodiments, the structure is a cellular membrane of a cell.

In certain embodiments, the cell is an animal cell, a plant cell, a fungal cell, a yeast cell, a bacterial cell, or an archaebacterial cell. In certain embodiments, the cell is an oocyte, a fibroblast, an epithelial cell, or a myocyte. In certain embodiments, the cell is a cell from a cell line.

In certain embodiments, the cellular membrane is in a cell. In certain embodiments, the cellular membrane is in a permeabilized cell. In certain embodiments, the cellular membrane is not in a cell. In certain embodiments, the cellular membrane comprises an extracellular membrane, an intracellular membrane, a vesicular membrane, an organelle membrane, or any combination thereof.

In certain embodiments, the contacting of step (b) is performed by adding the compound to either the first medium or the second medium. In certain embodiments, the cellular membrane the contacting of step (b) is performed by adding the compound to the first medium and the second medium. In certain embodiments, the method further comprises a step of contacting the voltage-gated ion channel with one or more ion channel modulating agents before step (b).

In certain embodiments, the one or more ion channel modulating agent is selected from the group comprising a turret blocking agent, a main-pore blocking agent, a gating-modifying agent, a cysteine-tethered reagent, or a voltage sensing domain toxin.

In certain embodiments, the voltage-gated ion channel is a proton channel, a sodium channel, a potassium channel, a calcium channel, or a voltage activated enzyme.

In certain embodiments, measuring the amount of independent ion permeation through the voltage-gated ion channel between the first and second media is by patch-clamp measurement. In certain embodiments, measuring the amount of independent ion permeation through the voltage-gated ion channel between the first and second media is by fluorescence measurement. In certain embodiments, measuring the amount of independent ion permeation through the voltage-gated ion channel between the first and second media is by radiolabeled measurement. In certain embodiments, measuring the amount of independent ion permeation through the voltage-gated ion channel between the first and second media is by biological assay measurement.

In certain embodiments, the independent ion permeation is omega-pore dependent ion permeation. In certain embodiments, the independent ion permeation is sigma-pore dependent ion permeation.

In certain embodiments, the one or more of the amino acid mutations are in one or more voltage sensing domains of the voltage-gated ion channel or the voltage sensitive phosphatase. In certain embodiments, the one or more of the amino acid mutations are S4 helix mutations. In certain embodiments, the one or more of the amino acid mutations are not S4 helix mutations. In certain embodiments, at least one of the amino acid mutations is an S4 helix mutation and at least one of the amino acid mutations is not an S4 helix mutation.

In certain embodiments, the method further comprises a step of contacting the voltage-gated ion channel with MTSET or MTSES before step (b). In certain embodiments, the method further comprises a step of contacting the voltage sensitive phosphatase with MTSET or MTSES before step (b).

BRIEF DESCRIPTION OF THE FIGURES

The patent or application file contains at least one drawing executed in color. Copies of this patent or patent application publication with color drawings will be provided by the Office upon request and payment of the necessary fee.

FIG. 9 indicates whether particular small molecule ligands, bound to the extracellular vestibule of a KV1Kv1.2/KV2.1 VSD, remain bound to the VSD or escape. Columns in this table, from left to right, are the ligand identifier, the VSD identifier, the ligand force field used, and whether the ligand escaped (and at what time).

FIG. 10 indicates whether particular small molecule ligands, bound to the extracellular vestibule of a Kv1.2 VSD, remain bound to the VSD or escape. Columns in this table, from left to right, are the ligand identifier, the VSD (and simulation run) identifier, the transmembrane potential, and whether the ligand escaped.

FIGS. 14A-AM show the amino acid sequences of various VGICs, including *Drosophila* Shaker (GI:288442) (SEQ ID NO: 1), human $Na_v$ 1.1 (HGNC: SCN1A) (SWISS-PROT: P35498) (SEQ ID NO: 2), human $Na_v$ 1.2 (HGNC: SCN2A) (SWISS-PROT: Q99250) (SEQ ID NO: 3), human $Na_v$ 1.3 (HGNC: SCN3A) (SWISS-PROT: Q9NY46) (SEQ ID NO: 4), human $Na_v$ 1.4 (HGNC: SCN4A) (GENBANK TRANSLATION: M81758) (SEQ ID NO: 5), human $Na_v$ 1.5 (HGNC: SCN5a) (SWISS-PROT: Q14524) (SEQ ID NO: 6), human $Na_v$ 1.6 (HGNC: SCN8A) (SWISS-PROT: O95788) (SEQ ID NO: 7), human $Na_v$ 1.7 (HGNC: SCN9A) (GENBANK TRANSLATION: X82835) (SEQ ID NO: 8), human $Na_v$ 1.8 (HGNC: SCN10A) (SWISS-PROT: Q9Y5Y9) (SEQ ID NO: 9), human $Na_v$ 1.9 (HGNC: SCN11A) (SWISS-PROT: Q9UHE0) (SEQ ID NO: 10), human $Ca_v$1.1 (HGNC: CACNA1S) (GENBANK TRANSLATION: L33798) (SEQ ID NO: 11), human $Ca_v$1.2 (HGNC: CACNA1C) (GENBANK TRANSLATION: L29529) (SEQ ID NO: 12), human $Ca_v$1.3 (HGNC: CACNA1D) (GENBANK TRANSLATION: M76558) (SEQ ID NO: 13), human $Ca_v$1.4 (HGNC: CACNA1F) (GENBANK TRANSLATION: AJ224874) (SEQ ID NO: 14), human $Ca_v$2.1 (HGNC: CACNA1A) (GENBANK TRANSLATION: AF004883) (SEQ ID NO: 15), human $Ca_v$2.2 (HGNC: CACN1B) (GENBANK TRANSLATION: M94172) (SEQ ID NO: 16), human $Ca_v$2.3 (HGNC: CACNA1E) (GENBANK TRANSLATION: L29384) (SEQ ID NO: 17), human $Ca_v$3.1 (HGNC: CACNA1G) (SWISS-PROT: O43497) (SEQ ID NO: 18), human $Ca_v$3.2 (HGNC: CACNA1H) (SWISS-PROT: O95180) (SEQ ID NO: 19), human $Ca_v$3.3 (HGNC: CACNA1I) (GENBANK: AAM67414) (SEQ ID NO: 20), human $K_v$1.1 (NCBI: KCNA1) (NCBI: NM_000217) (SEQ ID NO: 21), human $K_v$1.2 (HGNC: KCNA2) (NCBI: NM_004974) (SEQ ID NO: 22), human $K_v$1.3 (HGNC: KCNA3) (NCBI: NM_002232) (SEQ ID NO: 23), human $K_v$1.4 (HGNC: KCNA4) (NCBI: NM_002233) (SEQ ID NO: 24), human $K_v$1.5 (HGNC: KCNA5) (NCBI: NM_002234) (SEQ ID NO: 25), human $K_v$1.6 (HGNC: KCNA6) (NCBI: NM_002235) (SEQ ID NO: 26), human $K_v$1.7 (HGNC: KCNA7) (NCBI: NM_031886) (SEQ ID NO: 27), human $K_v$1.8 (HGNC: KCNA10) (NCBI: NM_005549) (SEQ ID NO: 28), human $K_v$2.1 (HGNC: KCNB1) (NCBI: NM_004975) (SEQ ID NO: 29), human $K_v$2.2 (HGNC: KCNB2) (NCBI: NM_004770) (SEQ ID NO: 30), human $K_v$3.1 (HGNC: KCNC1) (NCBI: NM_004976) (SEQ ID NO: 31), human $K_v$3.2 (HGNC: KCNC2) (NCBI: NM_139136) (SEQ ID NO: 32), human $K_v$3.3 (HGNC: KCNC3) (NCBI: NM_004977) (SEQ ID NO: 33), human $K_v$3.4 (HGNC: KCNC4) (NCBI: NM_004978) (SEQ ID NO: 34), human $K_v$4.1 (HGNC: KCND1) (NCBI: NM_004979) (SEQ ID NO: 35), human $K_v$4.2 (HGNC: KCND2) (NCBI: NM_012281) (SEQ ID NO: 36), human $K_v$4.3 (HGNC: KCND3) (NCBI: NM_004980) (SEQ ID NO: 37), human $K_v$5.1 (HGNC: KCNF1) (NCBI: NM_002236) (SEQ ID NO: 38), human $K_v$6.1 (HGNC: KCNG1) (NCBI: NM_002237) (SEQ ID NO: 39), human $K_v$6.2 (HGNC: KCNG2) (NCBI: NM_012283) (SEQ ID NO: 40), human $K_v$6.3 (HGNC: KCNG3,) (NCBI: NM_133329) (SEQ ID NO: 41), human $K_v$6.4 (HGNC: KCNG4,) (NCBI: NM_172347) (SEQ ID NO: 42), human $K_v$7.1 (HGNC: KCNQ1,) (NCBI: NM_000218) (SEQ ID NO: 43), human $K_v$7.2 (HGNC: KCNA2,) (NCBI: NM_172107) (SEQ ID NO: 44), human $K_v$7.3 (HGNC: KCNA3,) (NCBI: NM_004519) (SEQ ID NO: 45), human $K_v$7.4 (HGNC: KCNA4) (NCBI: NM_004700) (SEQ ID NO: 46), human $K_v$7.5 (HGNC: KCNQ) (NCBI: NM_019842) (SEQ ID NO: 47), human $K_v$8.1 (HGNC: KCNV1,) (NCBI: NM_014379) (SEQ ID NO: 48), human $K_v$8.2 (HGNC: KCNV2,) (NCBI: NM_133497) (SEQ ID NO: 49), human $K_v$9.1 (HGNC: KCNS1,) (NCBI: NM_002251) (SEQ ID NO: 50), human $K_v$9.2 (HGNC: KCNS2,) (NCBI: NM_020697) (SEQ ID NO: 51), human $K_v$9.3 (HGNC: KCNS3) (NCBI: NM_023966) (SEQ ID NO: 52), human $K_v$10.1 (HGNC: KCNH1) (NCBI: NM_172362) (SEQ ID NO: 53), human $K_v$10.2 (HGNC: KCNH5) (NCBI: NM_139318) (SEQ ID NO: 54), human $K_v$11.1 (HGNC: KCNH2) (NCBI: NM_000238) (SEQ ID NO: 55), human $K_v$11.2 (HGNC: KCNH6) (NCBI: NM_030779) (SEQ ID NO: 56), human $K_v$11.3 (HGNC: KCNH7) (NCBI: NM_033272) (SEQ ID NO: 57), human $K_v$12.1 (HGNC: KCNH8) (NCBI: NM_144633) (SEQ ID NO: 58), human $K_v$12.2 (HGNC: KCNH3) (NCBI: NM_012284) (SEQ ID NO: 59), human $K_v$12.3 (HGNC: KCNH4) (NCBI: NM_012285) (SEQ ID NO: 60), human HCN1 (HGNC: HCN1) (NCBI: NM_021072) (SEQ ID NO: 61), human HCN2 (HGNC: HCN2) (NCBI: NM_001194) (SEQ ID NO: 62), human HCN3 (HGNC: HCN3) (NCBI: NM_020897) (SEQ ID NO: 63), human HCN4 (HGNC: HCN4) (NCBI: NM_005477) (SEQ ID NO: 64), human CatSper1 (HGNC: CatSper1) (GENBANK TRANSLATION: AF407333) (SEQ ID NO: 65), human CatSper2 (HGNC: None) (GENBANK TRANSLATION: AF411817) (SEQ ID NO: 66), human CatSper3 (HGNC: None) (GENBANK TRANSLATION: AF432876) (SEQ ID NO: 67), human CatSper4 (HGNC: None) (GENBANK TRANSLATION: BN000273) (SEQ ID NO: 68), human Hv1 (HGNC: HVCN1) (NCBI: NP 001035196.1) (SEQ ID NO: 69), human $K_{Ca}$1.1 (HGNC: KCNMA1) (NCBI: NM_001014797) (SEQ ID NO: 70), human $K_{Ca}$4.1 (HGNC: KCNT1) (NCBI: NM_020822) (SEQ ID NO: 71), human $K_{Ca}$4.2 (HGNC: KCNT2) (NCBI: NM_198503) (SEQ ID NO: 72), human TPC1 (HGNC: None) (NCBI: NP 001137291.1) (SEQ ID NO: 73), FIGS. 15A-BU show an amino acid sequence alignment of of various VGICs, including *Drosophila* Shaker (GI: 288442) (SEQ ID NO: 1), human $Na_v$ 1.1 (HGNC: SCN1A) (SWISS-PROT: P35498) (SEQ ID NO: 2), human $Na_v$ 1.2 (HGNC: SCN2A) (SWISS-PROT: Q99250) (SEQ ID NO: 3), human $Na_v$ 1.3 (HGNC: SCN3A) (SWISS-PROT: Q9NY46) (SEQ ID NO: 4), human $Na_v$ 1.4 (HGNC: SCN4A) (GENBANK TRANSLATION: M81758) (SEQ ID NO: 5), human $Na_v$ 1.5 (HGNC: SCN5a) (SWISS-PROT: Q14524) (SEQ ID NO: 6), human $Na_v$ 1.6 (HGNC: SCN8A) (SWISS-PROT: O95788) (SEQ ID NO: 7), human $Na_v$ 1.7 (HGNC: SCN9A) (GENBANK TRANSLATION: X82835) (SEQ ID NO: 8), human $Na_v$ 1.8 (HGNC: SCN10A) (SWISS-PROT: Q9Y5Y9) (SEQ ID NO: 9), human $Na_v$ 1.9 (HGNC: SCN11A) (SWISS-PROT: Q9UHE0) (SEQ ID NO: 10), human Ca$_v$1.1 (HGNC: CACNA1S) (GENBANK TRANSLATION: L33798) (SEQ ID NO: 11), human Ca$_v$1.2 (HGNC: CACNA1C) (GENBANK TRANSLATION: L29529) (SEQ ID NO: 12), human Ca$_v$1.3 (HGNC: CACNA1D) (GENBANK TRANSLATION: M76558) (SEQ ID NO: 13), human Ca$_v$1.4 (HGNC: CACNA1F) (GENBANK TRANSLATION: AJ224874) (SEQ ID NO: 14), human Ca$_v$2.1 (HGNC: CACNA1A) (GENBANK TRANSLATION: AF004883) (SEQ ID NO: 15), human Ca$_v$2.2 (HGNC: CACN1B) (GENBANK TRANSLATION: M94172) (SEQ ID NO: 16), human Ca$_v$2.3 (HGNC: CACNA1E) (GENBANK TRANSLATION: L29384) (SEQ ID NO: 17), human Ca$_v$3.1 (HGNC: CACNA1G) (SWISS-PROT: O43497) (SEQ ID NO: 18), human Ca$_v$3.2 (HGNC: CACNA1H) (SWISS-PROT: O95180) (SEQ ID NO: 19), human Ca$_v$3.3 (HGNC: CACNA1I) (GENBANK: AAM67414) (SEQ ID NO: 20), human K$_v$1.1 (NCBI: KCNA1) (NCBI: NM_000217) (SEQ ID NO: 21), human K$_v$1.2 (HGNC: KCNA2) (NCBI: NM_004974) (SEQ ID NO: 22), human K$_v$1.3 (HGNC: KCNA3) (NCBI: NM_002232) (SEQ ID NO: 23), human K$_v$1.4 (HGNC: KCNA4) (NCBI: NM_002233) (SEQ ID NO: 24), human K$_v$1.5 (HGNC: KCNA5) (NCBI: NM_002234) (SEQ ID NO: 25), human K$_v$1.6 (HGNC: KCNA6) (NCBI: NM_002235) (SEQ ID NO: 26), human K$_v$1.7 (HGNC: KCNA7) (NCBI: NM_031886) (SEQ ID NO: 27), human K$_v$1.8 (HGNC: KCNA10) (NCBI: NM_005549) (SEQ ID NO: 28), human K$_v$2.1 (HGNC: KCNB1) (NCBI: NM_004975) (SEQ ID NO: 29), human K$_v$2.2 (HGNC: KCNB2) (NCBI: NM_004770) (SEQ ID NO: 30), human K$_v$3.1 (HGNC: KCNC1) (NCBI: NM_004976) (SEQ ID NO: 31), human K$_v$3.2 (HGNC: KCNC2) (NCBI: NM_139136) (SEQ ID NO: 32), human K$_v$3.3 (HGNC: KCNC3) (NCBI: NM_004977) (SEQ ID NO: 33), human K$_v$3.4 (HGNC: KCNC4) (NCBI: NM_004978) (SEQ ID NO: 34), human K$_v$4.1 (HGNC: KCND1) (NCBI: NM_004979) (SEQ ID NO: 35), human K$_v$4.2 (HGNC: KCND2) (NCBI: NM_012281) (SEQ ID NO: 36), human K$_v$4.3 (HGNC: KCND3) (NCBI: NM_004980) (SEQ ID NO: 37), human K$_v$5.1 (HGNC: KCNF1) (NCBI: NM_002236) (SEQ ID NO: 38), human K$_v$6.1 (HGNC: KCNG1) (NCBI: NM_002237) (SEQ ID NO: 39), human K$_v$6.2 (HGNC: KCNG2) (NCBI: NM_012283) (SEQ ID NO: 40), human K$_v$6.3 (HGNC: KCNG3,) (NCBI: NM_133329) (SEQ ID NO: 41), human K$_v$6.4 (HGNC: KCNG4,) (NCBI: NM_172347) (SEQ ID NO: 42), human K$_v$7.1 (HGNC: KCNQ1,) (NCBI: NM_000218) (SEQ ID NO: 43), human K$_v$7.2 (HGNC: KCNA2,) (NCBI: NM_172107) (SEQ ID NO: 44), human K$_v$7.3 (HGNC: KCNA3,) (NCBI: NM_004519) (SEQ ID NO: 45), human K$_v$7.4 (HGNC: KCNA4) (NCBI: NM_004700) (SEQ ID NO: 46), human K$_v$7.5 (HGNC: KCNQ) (NCBI: NM_019842) (SEQ ID NO: 47), human K$_v$8.1 (HGNC: KCNV1,) (NCBI: NM_014379) (SEQ ID NO: 48), human K$_v$8.2 (HGNC: KCNV2,) (NCBI: NM_133497) (SEQ ID NO: 49), human K$_v$9.1 (HGNC: KCNS1,) (NCBI: NM_002251) (SEQ ID NO: 50), human K$_v$9.2 (HGNC: KCNS2,) (NCBI: NM_020697) (SEQ ID NO: 51), human K$_v$9.3 (HGNC: KCNS3) (NCBI: NM_023966) (SEQ ID NO: 52), human K$_v$10.1 (HGNC: KCNH1) (NCBI: NM_172362) (SEQ ID NO: 53), human K$_v$10.2 (HGNC: KCNH5) (NCBI: NM_139318) (SEQ ID NO: 54), human K$_v$11.1 (HGNC: KCNH2) (NCBI: NM_000238) (SEQ ID NO: 55), human K$_v$11.2 (HGNC: KCNH6) (NCBI: NM_030779) (SEQ ID NO: 56), human K$_v$11.3 (HGNC: KCNH7) (NCBI: NM_033272) (SEQ ID NO: 57), human K$_v$12.1 (HGNC: KCNH8) (NCBI: NM_144633) (SEQ ID NO: 58), human K$_v$12.2 (HGNC: KCNH3) (NCBI: NM_012284) (SEQ ID NO: 59), human K$_v$12.3 (HGNC: KCNH4) (NCBI: NM_012285) (SEQ ID NO: 60), human HCN1 (HGNC: HCN1) (NCBI: NM_021072) (SEQ ID NO: 61), human HCN2 (HGNC: HCN2) (NCBI: NM_001194) (SEQ ID NO: 62), human HCN3 (HGNC: HCN3) (NCBI: NM_020897) (SEQ ID NO: 63), human HCN4 (HGNC: HCN4) (NCBI: NM_005477) (SEQ ID NO: 64), human CatSper1 (HGNC: CatSper1) (GENBANK TRANSLATION: AF407333) (SEQ ID NO: 65), human CatSper2 (HGNC: None) (GENBANK TRANSLATION: AF411817) (SEQ ID NO: 66), human CatSper3 (HGNC: None) (GENBANK TRANSLATION: AF432876) (SEQ ID NO: 67), human CatSper4 (HGNC: None) (GENBANK TRANSLATION: BN000273) (SEQ ID NO: 68), human Hv1 (HGNC: HVCN1) (NCBI: NP 001035196.1) (SEQ ID NO: 69), human K$_{Ca}$1.1 (HGNC: KCNMA1) (NCBI: NM_001014797) (SEQ ID NO: 70), human K$_{Ca}$4.1 (HGNC: KCNT1) (NCBI: NM_020822) (SEQ ID NO: 71), human K$_{Ca}$4.2 (HGNC: KCNT2) (NCBI: NM_198503) (SEQ ID NO: 72), human TPC1 (HGNC: None) (NCBI: NP 001137291.1) (SEQ ID NO: 73). The alignment was generated using the Clustal W2 multiple sequence alignment tool according to the following parameters: (a) Protein Wieght Matrix: BLOSUM; (b) Gap Open: 5; (c) Gap Extension: 0.1; (d) Gap Distances: 5; (e) End Gaps; (f) No iteration; (g) Numiter: 1; (h) Clustering: NJ.

FIGS. 16A-D show the activated-state-to-resting-state transition of a voltage-gated K+ channel. Membrane-lateral (FIG. 16A, FIG. 16B) and intracellular (FIG. 16C, FIG. 16D) views of activated (FIG. 16A, FIG. 16C; open, conducting) and resting (FIG. 16B, FIG. 16D; closed, non-conducting) states of KV1.2/KV2.1; two or four subunits are shown, along with K+ ions (green) and water molecules (red/white) in the selectivity filter (SF). The graph indicates the number of pore cavity water molecules (grey surface). Magnified views in b and d illustrate water-filled and empty pore cavities in activated and resting states (hydrophobic constriction at the conserved Pro-Val-Pro motif [purple]). Results from simulations either with ("T1+") or without ("T1−") the functionally nonessential cytoplasmic T1 domain, separated by dashed lines, are both shown in d. In the resting state, helix S6 is locked into a straight conformation by Leu331 (S5)-Pro405 (S6) side-chain interchange (M. Ø. Jensen et al., (2010) Proc. Natl. Acad. Sci. USA 107:5833-5838). Inset: K+ currents. The currents and H2O/K+ permeation ratio (~1) agree with experiment (H. Ando et al., (2005) J. Gen. Physiol. 126:529-538) and pore-only simulations (M. Ø. Jensen et al., (2010) Proc. Natl. Acad. Sci. USA 107:5833-5838). VSD-pore separation (right), which increases, for instance, the R1(Q)-Ala351 distance by ~20 Å, explains lack of resting-state inter-domain crosslinking (M. Lainè et al., Neuron 39:467-481). Both states are compatible with Shaker tryptophan tolerance mutagenesis data of VSD helices S1-S3a (K. H. Hong & C. Miller, (2000) J. Gen. Physiol. 115:51-58).

FIGS. 17A-D show VSD motion during gating. FIG. 17A: Consecutive VSD configurations illustrate sequential inward movement of the S4 gating-charge residues during the gating transition; the four individually colored traces track the position of their Cα atoms. R2 exhibits a Cα displacement of 15.4±2.5 Å, averaged over all fully relaxed, resting state VSDs in T1− simulations 2 and 3, and 14.3±0.9 Å for T1+ (sim. 8), in agreement with KvAP (V. Ruta et al., (2005) Cell 123:463-475; A. Banerjee & R. MacKinnon, (2008) J. Mol. Biol. 381:569-580) and Shaker (H. P. Larsson et al., (1996) Neuron 16:387-397) accessibility data, and with crosslinking of, for instance, Shaker Ile230 (S2) and R1(Q) only in the resting state (F. V. Campos et al., (2007) Proc. Natl. Acad. Sci. USA 104:7904-7909). FIG. 17B: Local S4 helix rotation vs R2-R4 z-positions. FIG. 17C: Cumulative VSD gating charge displacements, $Q(t)=\Sigma_i\, q_i\, [f(z_i,t)-f(z_i, 0)]$. $f(z)$ is the fractional potential drop (blue/white/red background in a) along the membrane normal, z; $z_i$,t is the z-position of VSD atom i at time t, and $q_i$ is its partial charge. The gating charge, 13.3±0.4 e, was estimated as the difference between the final (average) charge displacements at depolarizing and hyperpolarizing potentials; the gating process was initiated at −750 mV, reducing the magnitude to −375 mV at −70 is (sim. 3 [see FIGS. 21]) and ~145 is (sim. 4), and increasing it to −500 mV at −205 is (sim. 8). The contribution of S4 only is explicitly shown (black) for one simulation, revealing that S4 fully accounts for the gating charge displacement. Inset: Fractional potential drop across the VSD, in both activated and resting states, obtained from free energy calculations; gating-charge residue z-positions are also shown. FIG. 17D: Cα root-mean-square deviations for the entire channel tetramer, the pore domain (tetramer), and a single VSD decomposed into S1-S3a (loops omitted), S3b-S4 (the "paddle"), and S4 alone. Inset: Schematic of the full channel.

FIGS. 18A-H show key steps of resting-state-to-activated-state transition of a voltage-gated K+ channel. Deactivation (red) and early reactivation (blue; first ~100 μs) upon depolarization (FIG. 18A, FIG. 18B): inward and outward movement of S4 gating-charge residues and "paddle" Cα RMSD relative to the initial structure (FIG. 18A), and total gating charge transfer (FIG. 18B). Late reactivation (c-h; final ~10 μs, after essentially all gating charge has been transferred): pore cavity rewetting, Leu331 (S5)-Pro405 (S6) side-chain interchange, and cumulative outward K+ permeation events (FIG. 18C); K+ population of pore cavity (FIG. 18D) and SF (FIG. 18E); S4-S5 linker/helix S6 interaction energies (FIG. 18F); S4-S5 linker/helix S6 contacts (FIG. 18G); and upper gate (Ile402/site S5) lateral opening (FIG. 18H).

FIGS. 20A-C show the "omega" pore. Resting state conformations of wild type (FIG. 20A) and R2Ser mutant (FIG. 20C) VSDs. Spheres in (FIG. 20A) mark residues accessible to chemical modification from the extracellular (yellow) and intracellular (purple) sides in the resting state (H. P. Larsson et al., (1996) Transmembrane movement of the Shaker K+ channel S4. Neuron 16:387-397), consistent with ~15-Å S4 inward motion [see FIG. 17a]. FIG. 20B Water and K+ (R2Ser) densities (arbitrary units). The R2Ser mutation increases hydration at Phe233 by ~50%, facilitating in part K+ permeation. The ion permeation pathway—the omega pore—in the R2Ser mutant is shown as a green mesh in (FIG. 20C). The green surface and spheres indicate predominant K+"sites" and actual positions from a single permeation event; the blue surfaces represent VSD hydration.

FIG. 21 shows a summary of simulations. Listed for each simulation are the force field; presence (+) or absence (−) of the T1 domain; the approximate number of atoms; the total simulation time; the applied voltage (when the voltage was adjusted toward the end of the simulation the final value is given in parenthesis); the times for pore half- and full-dewetting (i.e., pore closure); the gating charge at closure; and, at simulation end, the number of gating-charge arginine residues ("Rs"; R-1, R0, R2, R3, R4) in each of the voltage-sensing domains (VSDs; subunits A/B/C/D) that were at, or inward of, Phe233; and the gating charge transferred ($q_g$). The time at which the pore closed was defined as when the water occupancy of the pore cavity dropped below five water molecules; the half-dewetted time was defined as when <25 water molecules occupied the cavity. Reactivation simulations 12 and 13 started from resting state configurations obtained from simulation 8, either with all VSDs but one fully down (Rs: 3/3/1/3; simulation 12), or with all VSDs fully down (Rs: 3/3/3/3; simulation 13). Simulation 14 was a control simulation with the TIP4P water model (SF patch omitted). The simulation was stopped at ~60 μs after observation of dewetting and initial gating charge movement.

FIG. 22 shows a revised side-chain partial charges. Revised charges for aspartate, glutamate, and arginine side-chain atoms, denoted by "DER" and "DER2" The corresponding original CHARMM27 ("C27") charges are also shown.

FIG. 23 shows omega pore simulations. Two mutants—R2Ser and R0Asn—were simulated with or without an additional glutamate-to-aspartate mutation at position 226. Listed for each simulation are the voltage; simulation time (time used for analysis); inward K+ leak current; and average gating charge. The analysis time was typically shorter than the total simulated time because the isolated VSDs were unstable over longer timescales at |V|>750 mV; at approximately ~400 mV, however, the VSDs were stable for longer than 100 μs. Calculation of the average cumulative charge displacements indicates that the gating charge of both mutants is ~2 e per subunit.

FIGS. 24A-B show double bilayer simulations. FIG. 24A. The transmembrane potential through the VSD-centered on the R4 side chain for the activated state, and the R2 side chain for the resting state—was computed as the difference between the electrostatic potentials from the charge-imbalanced and charge-balanced double bilayer simulations (simulation times are given in parentheses), using the VMD PMEPOT plugin (A. Aksimentiev, K. Schulten, Imaging α-hemolysin with molecular dynamics: Ionic conductance, osmotic permeability and the electrostatic potential map. *Biophys. J.* 88, 3745-3761 (2005)) interfaced to HiMach (T.

Tu et al., A scalable parallel framework for analyzing terascale molecular dynamics simulation trajectories. *Proceedings of the ACM/IEEE Conference on Supercomputing (SC08)* (ACM Press, New York, 2008)). For each state subject to neutral or hyperpolarizing potentials, average potential profiles along the z-axis through the VSD were computed as an average over the (time-averaged) profiles lying within 1.6 Å radius (in the xy-plane) from the VSD center. The charge difference leads to a transmembrane potential difference of 558±1.4 mV computed from the activated state double bilayer trajectory as the difference in between electrostatic potentials in the "inner" and "outer" compartments. FIG. 24 B: Outward and inward K+ currents (simulations 1 and 5).

FIGS. 25A-E show protein—lipid interactions. FIG. 25A: Upper panel: lipid exposure for VSD S1-S3a residues, in activated and resting states, compared to experimental Trp-substitution tolerance data (K. H. Hong, C. Miller, The lipid-protein interface of a Shaker K$^+$ channel. *J. Gen. Physiol.* 115, 51-58 (2000)). FIG. 25B: Resting-to-activated state difference in exposure. FIG. 25C: Resting-to-activated state difference for VSD S5-S6 residues. FIG. 25D: Individual S4 gating-charge residue coordination to lipid phosphate groups in activated (A) and resting (R) states, using the first 10 and last 30 μs of simulations 5 and 6 at a hyperpolarizing voltage. For comparison, coordination to the activated state at a depolarizing voltage (simulation 1) is also shown. FIG. 25E: Snapshots of lipid coordination to R0 in the activated state (left) and to R-1, R0, R2, R4 and K5 in the resting state (right).

FIGS. 29A-R show amino acid sequences for the voltage sensing domains of Homo_hvcn1 gi_91992153_(SEQ ID NO: 74); Gallus_hvcn gi_71897219_(SEQ ID NO: 75); opossum_hvcn gi_12632423_(SEQ ID NO: 76); 004 rat_hvcn1 gi_109497399_(SEQ ID NO: 77); *Equus*_hvcn1 gi_194214323_(SEQ ID NO: 78); bos_hvcn1 gi_119909285_(SEQ ID NO: 79); sus_hvcn1 gi_194042948_(SEQ ID NO: 80); *Macaca*_hvcn_4 gi_109098724_(SEQ ID NO: 81); *Macaca*_hvcn gi_109098722_(SEQ ID NO: 82); *Macaca*_hvcn_2 gi_10909872_(SEQ ID NO: 83); dog_hvcn1 2 gi_73994604_(SEQ ID NO: 84); dog_hvcn1 gi_73994606_ (SEQ ID NO: 85); mus_hvcn1 gi_109809757_(SEQ ID NO: 86); *Xenopus*_t_hvcn1 gi_58332220_(SEQ ID NO: 87); *Xenopus*_1_hvcn1 gi_148235789_148235(SEQ ID NO: 88); *Danio*_hvcn1 gi_50539752_(SEQ ID NO: 89); tetraodon_hvcn1 gi_47209646_(SEQ ID NO: 90); takifugu_hvcn1 ENSEMBL UPI00016E3E8E(SEQ ID NO: 91); nematostella_hvcn gi_156364735_(SEQ ID NO: 92); *Ciona*_hvcn gi_118344228_(SEQ ID NO: 93); trichoplex_hvcn1 gi_196002093_(SEQ ID NO: 94); human_CACNA1E_repeat_3 gi_53832005_(SEQ ID NO: 95); *Drosophila*_CAC1A_repeat_3 gi_24641459_(SEQ ID NO: 96); mouse_CAC1H_repeat_1 gi_254826786_(SEQ ID NO: 97); *Homo*_CAC1I_repeat_1 gi_51093859_(SEQ ID NO: 98); *Homo*_CAC1G_repeat3 sp_O43497(SEQ ID NO: 99); *Gallus*_SCN1A_repeat1 uniprot_E1C4S3(SEQ ID NO: 100); rat_SCN2A_repeat1 sp_P04775(SEQ ID NO: 101); mouse_SCN1A_repeat1 uniprot_A2APX8(SEQ ID NO: 102); mouse_SCN1A_repeat1 uniprot_A2APX7(SEQ ID NO: 103); rat_SCN11A_repeat1 sp_O88457(SEQ ID NO: 104); mouse_SCN11A_repeat1 sp_Q9R053(SEQ ID NO: 105); *Homo*_SCN11A_repeat1 sp_Q9UI33(SEQ ID NO: 106); taeniopygia_SCN_repeat1 gi_224044620 (SEQ ID NO: 107); *Homo*_SCN4A_repeat1 sp_P35499(SEQ ID NO: 199); rat_SCN5A_repeat1 sp_P15389(SEQ ID NO: 108); rat_SCN9A_repeat1 sp_O08562(SEQ ID NO: 109); rabbit_SCN9A_repeat1 sp_Q28644(SEQ ID NO: 110); *Homo*_SNC3A_repeat1 sp_Q9NY46(SEQ ID NO: 111); *Canis*_SCN_repeat1 gi_74004456 (SEQ ID NO: 112); *Danio*_SCN8AA_repeat1 sp_Q9DF53(SEQ ID NO: 113); mouse_SCN8A_repeat1 sp_Q9WTU3(SEQ ID NO: 114); *Canis*_SCNAA_repeat1 sp_O46669(SEQ ID NO: 115); *Homo*_SCN7A_repeat1 sp_Q01118(SEQ ID NO: 116); rabbit_CAC1C_repeat1 sp_P15381(SEQ ID NO: 117); mouse_CAC1S_repeat1 sp_Q02789(SEQ ID NO: 118); mouse_CAC1F_repeat1 sp_Q9JIS7(SEQ ID NO: 119); *Gallus*_CAC1D_repeat1 sp 073700(SEQ ID NO: 120); *Homo*_CACN_repeat1 gi_193788728 (SEQ ID NO: 121); *Drosophila*_CAC1D_repeat1 sp_Q24270(SEQ ID NO: 122); *Homo*_CAC1A_repeat1 sp_O00555(SEQ ID NO: 123); *Homo*_CAC1B_repeat1 sp_Q00975(SEQ ID NO: 124); rat_SCN11A_repeat3 sp_O88457(SEQ ID NO: 125); mouse_SCN11A_repeat3 sp_Q9R053(SEQ ID NO: 126); rat_SCN9A_repeat3 sp_O08562(SEQ ID NO: 127); rabbit_SCN9A_repeat3 sp_Q28644(SEQ ID NO: 128); mouse_SCN9A_repeat3 uniprot_B7ZWN(SEQ ID NO: 129); mouse_KCNH1 sp_Q60603(SEQ ID NO: 130); mouse_KCNH8 sp_P59111(SEQ ID NO: 131); *Homo*_KCNH3 sp_Q9ULD8(SEQ ID NO: 132); *Homo*_CAC1G_repeat4 sp_O43497(SEQ ID NO: 133); mouse_SCN11A_repeat4 sp_Q9R053(SEQ ID NO: 134); rat_SCN9A_repeat4 sp_O08562(SEQ ID NO: 135); rat_SCN11A_repeat4 sp_O88457(SEQ ID NO: 136); humo_CAC1G_repeat2 sp_O43497(SEQ ID NO: 137); *Homo*_CACNA1E_repeat_4 sp_Q15878(SEQ ID NO: 138); *Drosophila*_CAC1A_repeat_4 sp_P91645(SEQ ID NO: 139); *Homo*_KCNV2 sp_Q8TDN2(SEQ ID NO: 140); *Homo*_KCNF1 sp_Q9H3M0_KCNF1(SEQ ID NO: 141); *Homo*_KCNB1 sp_Q14721(SEQ ID NO: 142); *Cani*- s_KCNB2 sp_Q95167(SEQ ID NO: 143); Drosophila_KCNAB sp_P17970(SEQ ID NO: 144); pongo_KCNV1 sp_Q5RC10(SEQ ID NO: 145); Homo_KCNS3 sp_Q9BQ31(SEQ ID NO: 146); squirrelmonkey_KCNS1 sp A4K2X4(SEQ ID NO: 147); Gallus_KCNG2 sp_O73606 (SEQ ID NO: 148); Homo_KCNG4 sp_Q8TDN1(SEQ ID NO: 149); rat_KCNC3 sp_Q01956_KCNC3(SEQ ID NO: 150); Homo_KCNC2 sp_Q96PR1(SEQ ID NO: 151); drosophila KCNAW sp_P17972(SEQ ID NO: 152); Homo_KCNA1 sp_Q09470(SEQ ID NO: 153); rat KNCA6 sp_P17659(SEQ ID NO: 154); Homo_KCNA5 sp_P22460 (SEQ ID NO: 155); rat_KCNA3 sp_P15384(SEQ ID NO: 156); Canis_Kv1.3 gi_57088651_(SEQ ID NO: 157); bovine_KCNA4 sp_Q05037(SEQ ID NO: 158); Homo_KCA10 sp_Q16322(SEQ ID NO: 159); rat_Kv1.2 2R9R_b_vs gi_16087779_(SEQ ID NO: 160); Homo_Kv gi_4826782_(SEQ ID NO: 161); rat_Kv pdb:2A79_chainb (SEQ ID NO: 162); Canis_KCNA2 sp_Q28293(SEQ ID NO: 163); Drosophila_shaker_Kchannel gi_288442_(SEQ ID NO: 164); rabbit_KCND3 sp_Q9TTT5(SEQ ID NO: 165); hum_CACNA1E_repeat_2 sp_Q15878(SEQ ID NO: 166); Drosophila_CAC1A_repeat_2 sp_P91645(SEQ ID NO: 167); mouse_SCN11A_repeat2 sp_Q9R053(SEQ ID NO: 168); rat_SCN11A_repeat2 sp_O88457(SEQ ID NO: 169); rat_SCN9A_repeat2 sp_O08562(SEQ ID NO: 170); ornitho_C15orf27_gi_149410687_(SEQ ID NO: 171); Danio_c15orf27 gi_123703002_(SEQ ID NO: 172); monodelphis_C15orf27 gi_12627230_(SEQ ID NO: 173); sus_C15orf27 gi_194039682 (SEQ ID NO: 174); Homo_C15orf27 gi_118442841_(SEQ ID NO: 175); pan_C15orf27_gi_114658268_(SEQ ID NO: 176); horse_C15orf27 gi_149692210_(SEQ ID NO: 177); mus_C15orf27 gi_27370422_(SEQ ID NO: 178); rat_C15or27 gi_157817759_(SEQ ID NO: 179); Ciona_C15orf gi_198433556 (SEQ ID NO: 180); Methanococcus_hyperpol_Kv sp_Q57603(SEQ ID NO: 181); ornitho_vsp gi_149635858_(SEQ ID NO: 182); Xenopus_t_vsp gi_62859843_(SEQ ID NO: 183); Gallus_vsp gi_118084924_(SEQ ID NO: 184); Danio_vsp gi_70887553_(SEQ ID NO: 185); Xenopus_vsp gi_148230800_(SEQ ID NO: 186); rat_vsp gi_157820295_ (SEQ ID NO: 187); mus_vsp gi_40549440_(SEQ ID NO: 188); dog_vsp gi_73993164_(SEQ ID NO: 189); human_vsp gi_213972591_(SEQ ID NO: 190); Homo_vsp_gamma gi_40549435_(SEQ ID NO: 191); Ciona_vsp gi_76253898_(SEQ ID NO: 192); Aeropyrum_Kv PDB_1ORS_c(SEQ ID NO: 201); Homo_BK gi_119574982_(SEQ ID NO: 193); and mouse_BK_mslo gi_4639628_(SEQ ID NO: 194).

Figure 1:
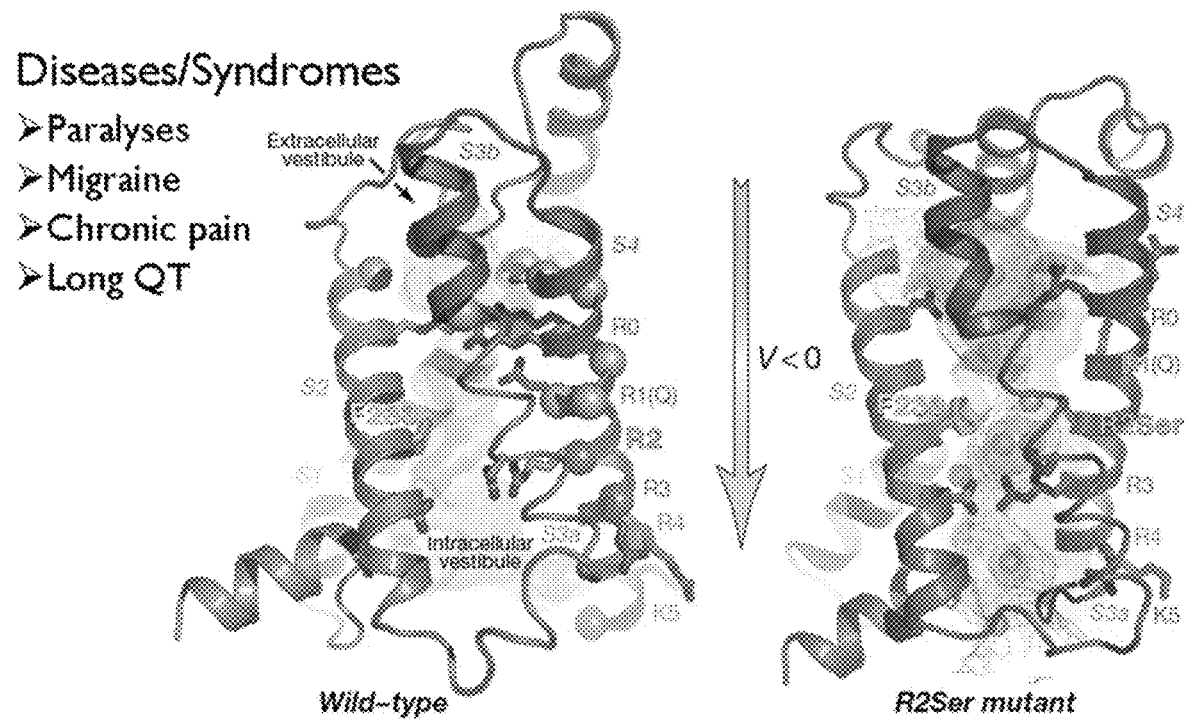
FIG. 1 shows the structural basis of Voltage Sensing Domain (VSD) channelopathies and that VSD gating charge mutations cause pathological cation leaks. Resting state conformations of wild type (left) and R2Ser mutant (right) VSDs are shown. Cations selectively leak through the mutant VSDs when the gating charge mutation is proximal to Phe233 (labeled F233).
Figure 2:
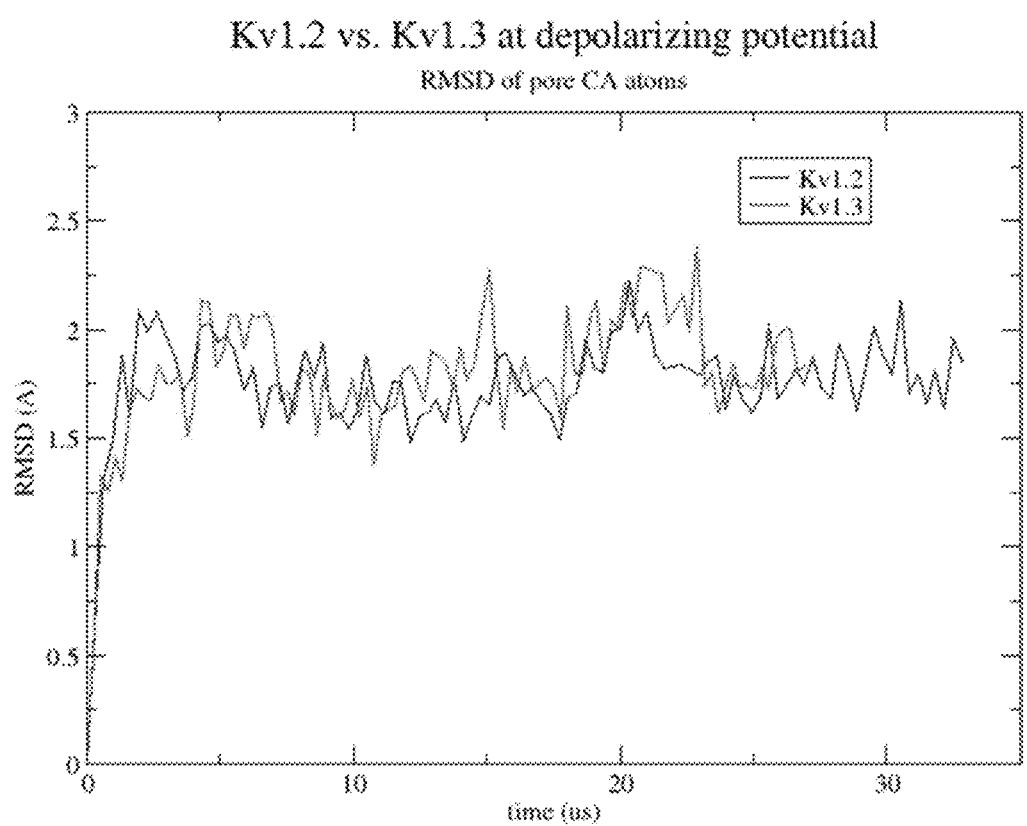
FIG. 2 shows that the Kv1.2 and Kv1.3 pore domains maintain stable structures during molecular dynamics simulations at depolarizing potential. The root-mean-square deviation (RMSD) of the pore domain CA atoms (all four (identical) subunits that compose the tetrameric pore) is plotted versus simulation time.
Figure 3:
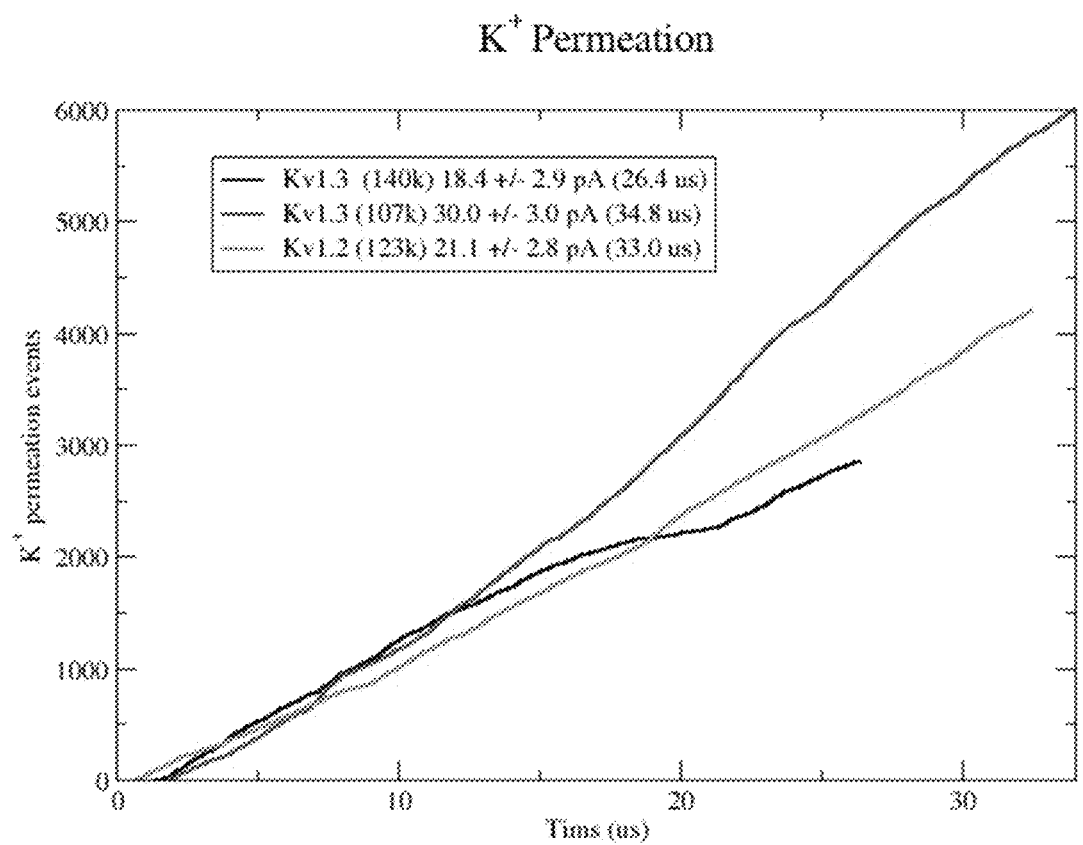
FIG. 3 shows $K^+$ permeation for Kv1.2 and Kv1.3. Cumulative $K^+$ permeation events through the pore domain, at depolarizing potential, are plotted versus simulation time.
Figure 4:
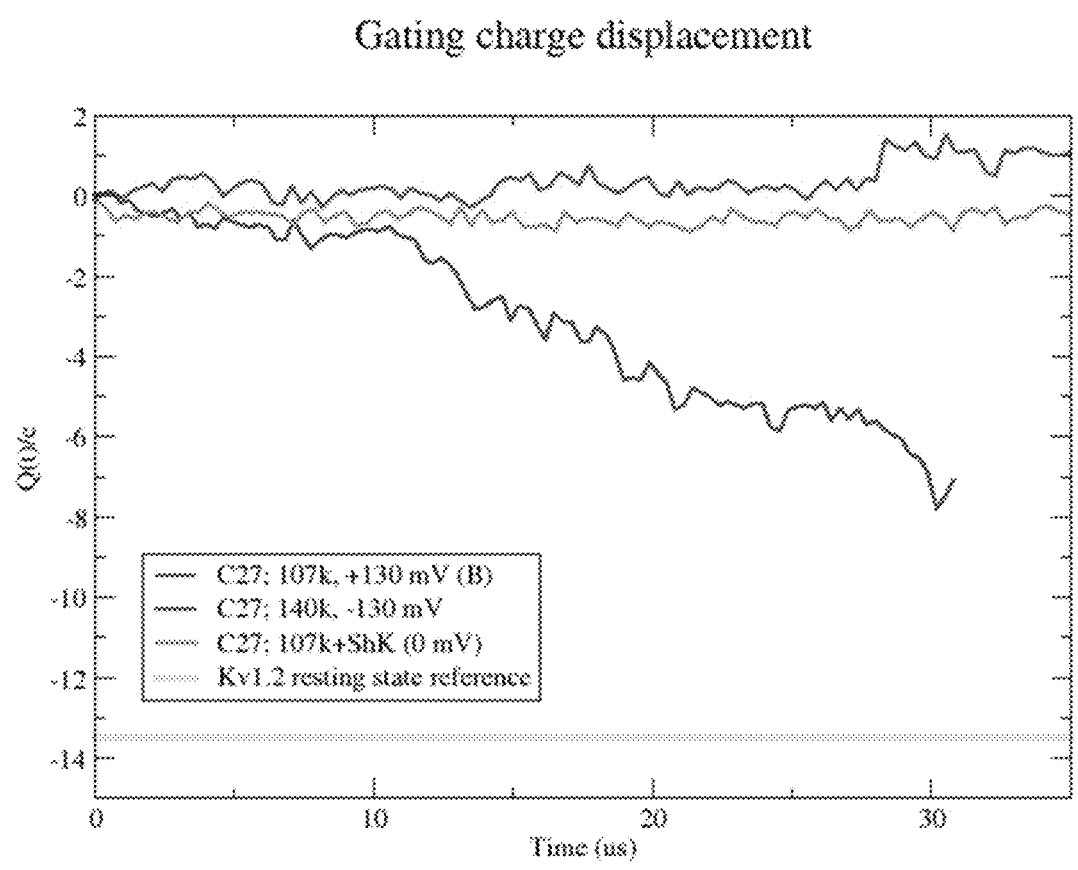
FIG. 4 shows gating charge displacement of Kv1.3 compared with the Kv1.2 resting state as reference. The Kv1.2 resting state gating charge displacement is shown at as grey line. The Kv1.3 gating charge displacement (red: depolarizing [control] potential; green: depolarizing potential with bound ShK toxin; blue: hyperpolarizing potential) is plotted versus simulation time. "C27" refers to the molecular dynamics force field used; the number of atoms in each simulation ("107 k", etc.) are indicated.
Figure 5:
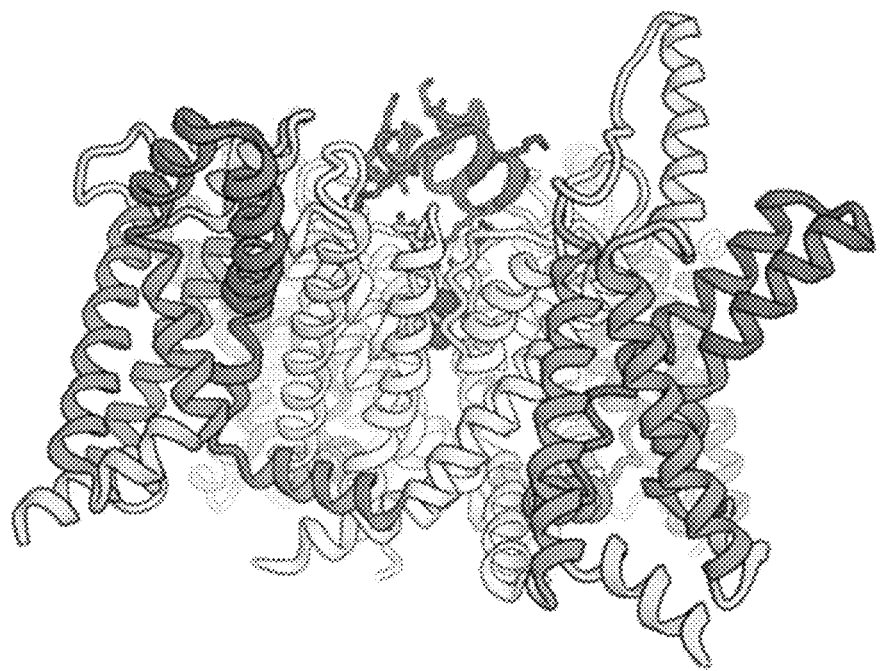
FIG. 5 shows the structure of the ShK/Kv1.3 complex. In this "ribbon" representation, based on the three-dimensional coordinates of the CA atoms, the pore domain of Kv1.3 is grey; the core of each VSD is green; the mobile S3b and S4 portions of each VSD are red; remaining portions of each VSD are light blue; and the ShK toxin is purple. ShK is bound to the pore at hyperpolarzing and weak depolarizing potentials, and blocks the ion permeation pathway from the extracellular side.
Figure 6:
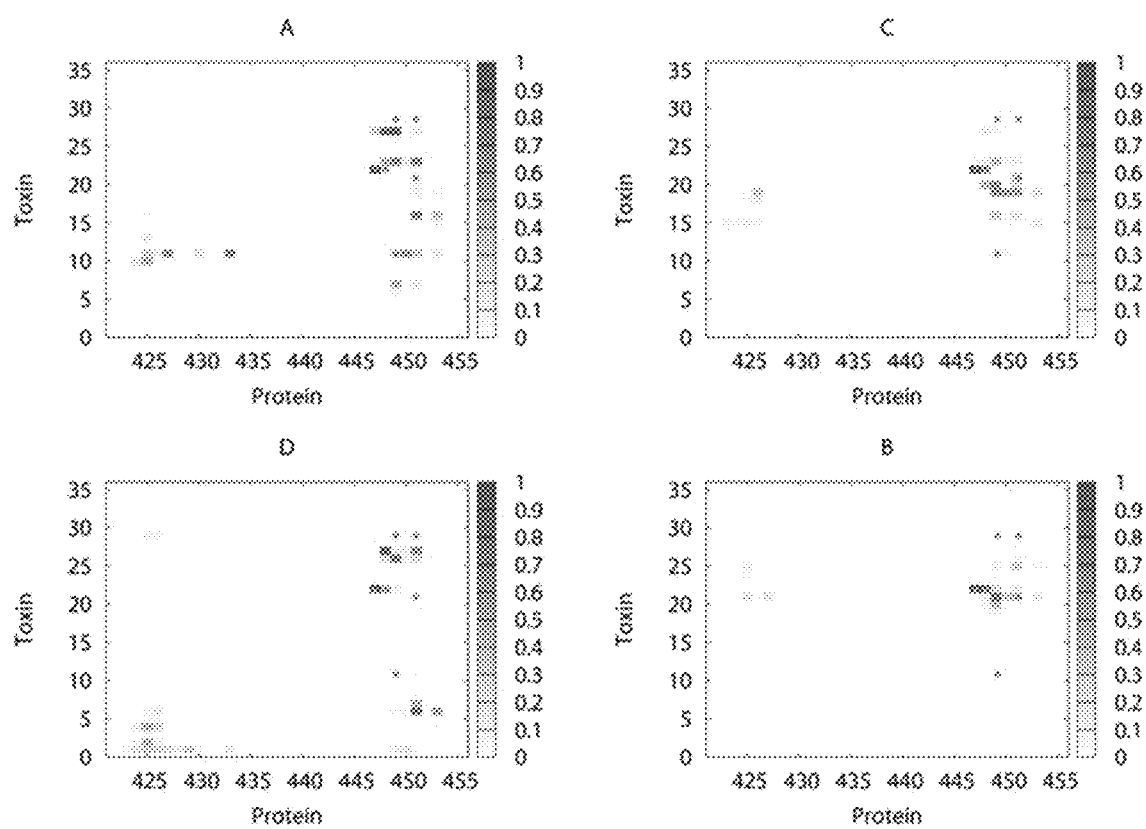
FIGS. 6A-D show a contact map of ShK and Kv1.3 interacting residues. Data are plotted separately for each subunit (FIG. 6A, FIG. 6B, FIG. 6C, and FIG. 6D) of the pore domain. Interactions (within 4 Å distance) between particular Kv1.3 residues (horizontal axis) and particular ShK residues (vertical axis) is indicated by the white-to-red color scale (red representing more contact). Green dots correspond to experimentally derived nuclear magnetic resonance data (Mol. Pharmacol. 75(4) 762-773 (2009); Mol. Pharmacol. 67(4) 1369-1381 (2005); JBC 274(31) 21885-21892 (1999); JBC 273(49) 32697-32707(1998); BBRC 219(3) 696-701 (1996))
Figure 7:
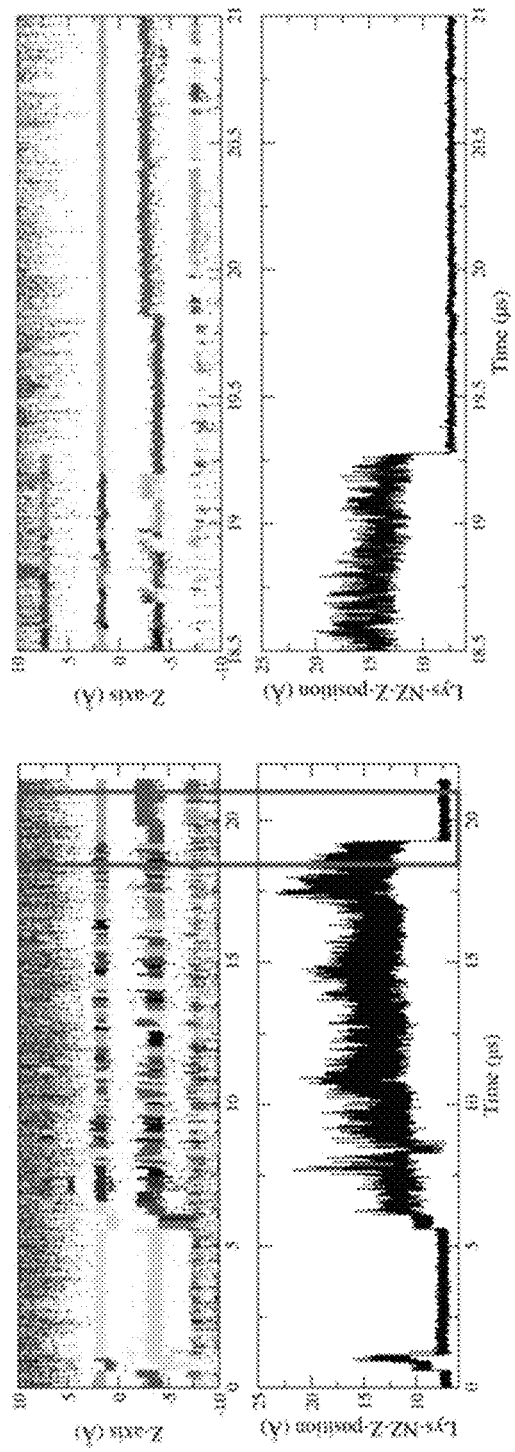
FIG. 7 shows that large depolarizing potentials separate Shk from the Kv1.3 pore. In the left panel, the positions of permeating K+(top; ions colored distinctly) and the ammonium group of ShK residue Lys22 (bottom) are plotted versus simulation time; the z coordinate is relative to the center of the membrane in which Kv1.3 is embedded. The K+ occupancy of the "S0 site" in the pore domain "selectivity filter" ("SF"; z~=7.5 Å) and the position of the ShK Lys22 ammonium group are correlated. Once the Sext and S0 sites are unoccupied by K+, the toxin can reach the pore domain "turret" insert a positive side chain (e.g., the Lys22 ammonium group) into the selectivity filter, thus occluding the S0 site. S0 is 50% occupied by K+, and Sext is presumably occupied even less. As the channel enters the non-conducting resting state (hyperpolarizing potentials), the ShK binding preferentially involves binding to states with S0 unoccupied. The on-rate increases with stronger hyperpolarizing voltage. The ShK off-rate increases with increased depolarizing voltage.
Figure 8:
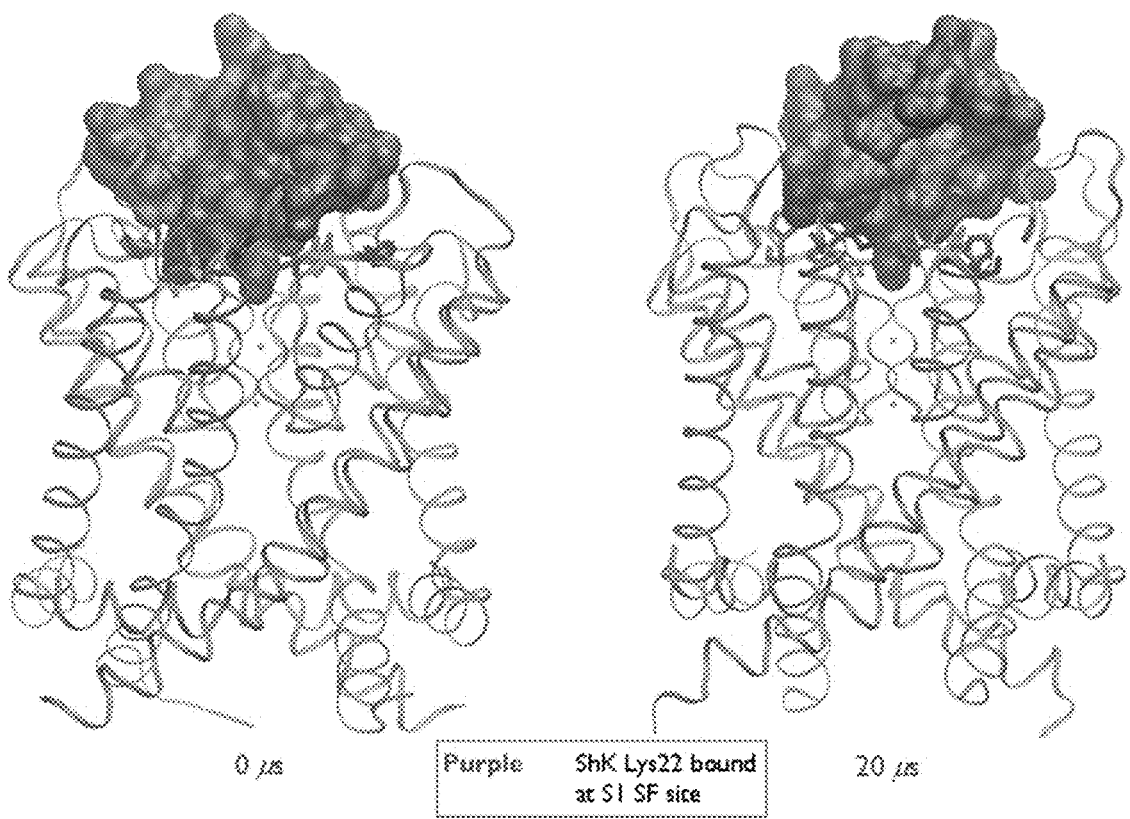
FIG. 8 shows the ShK toxin bound to the Kv1.3 pore. The Kv1.3 pore domain is shown as a green ribbon; ShK is shown as a molecular surface representation (mostly black), in which negatively charged residues are colored red and positively charged residues are colored blue. The purple highlight shows the ShK (positively charged) Lys22 bound at the Kv1.3 SF 51 site. Two different time snapshots, displaying two of several possible poses, from the simulation are shown.
Figure 11:
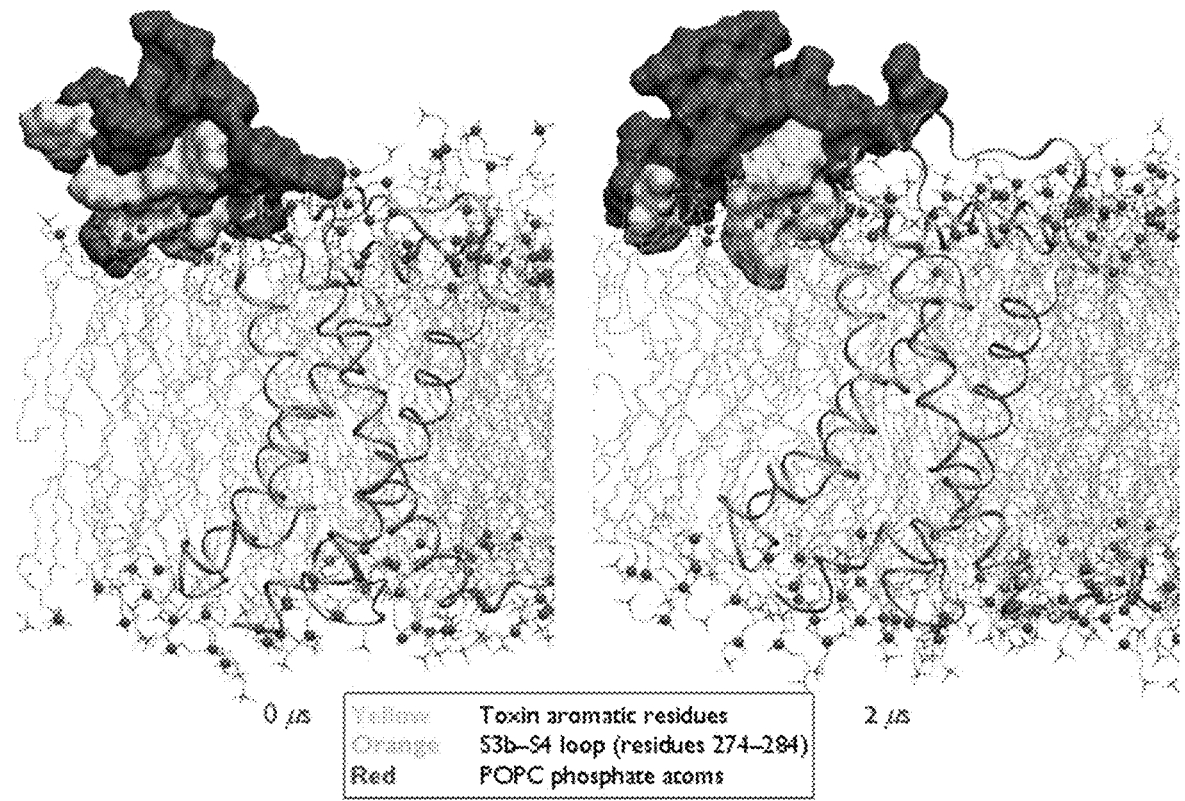
FIG. 11 shows GxTx-1E toxin bound in one of several possible binding modes, to the Kv1.2/Kv2.1 chimera VSD. The toxin is shown as a surface representation, with the aromatic residues colored yellow and the other residues colored blue. The VSD is shown as a cyan-colored ribbon representation, with the loop connecting S3b to S4 (residues 274-284) colored orange. The membrane lipids are shown as stick figures (colored cyan [carbon], blue [nitrogen], and red [oxygen and phosphorus]); the phosphate phosphorus atoms are highlighted as red spheres.
Figure 12:
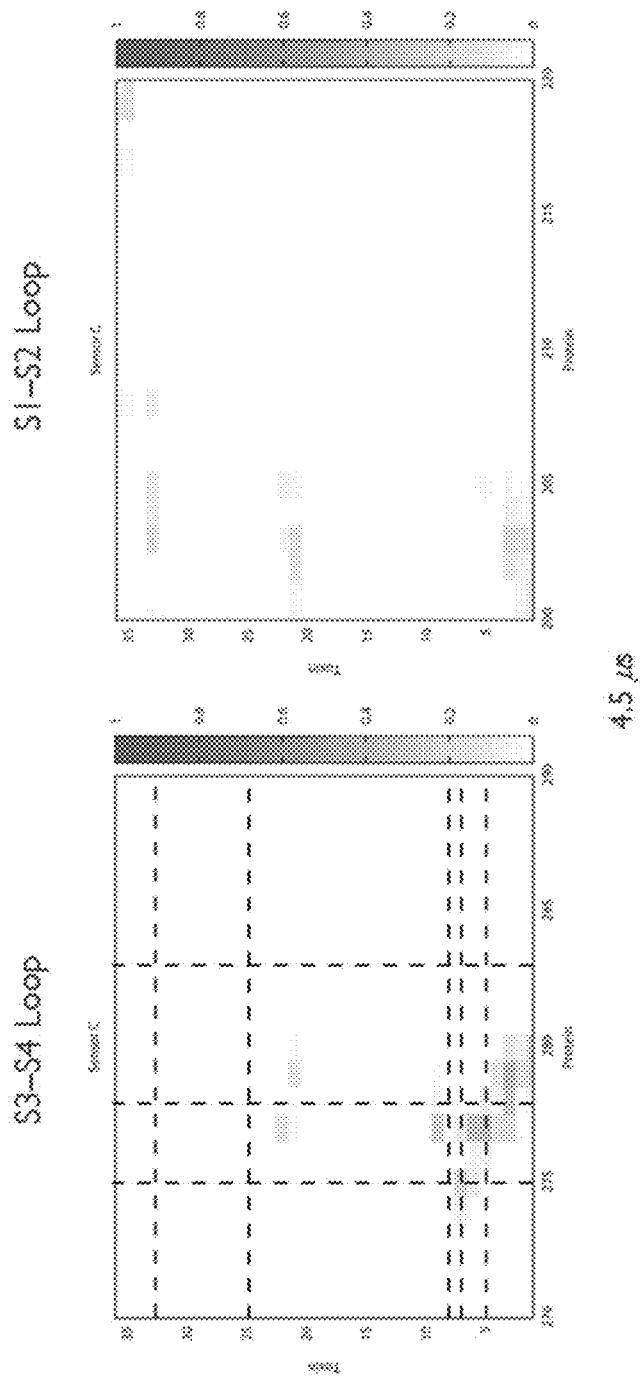
FIG. 12 shows a contact map of GxTx-1E and Kv1.2/Kv2.1 chimera VSD interacting residues. Data are plotted separately for the VSD S3-S4 (left) and S1-S2 (right) loops. Interactions between particular Kv1.2/Kv2.1 residues (horizontal axis) and particular GxTx-1E residues (vertical axis) is indicated by the white-to-red color scale (red representing more contact).
Figure 13:
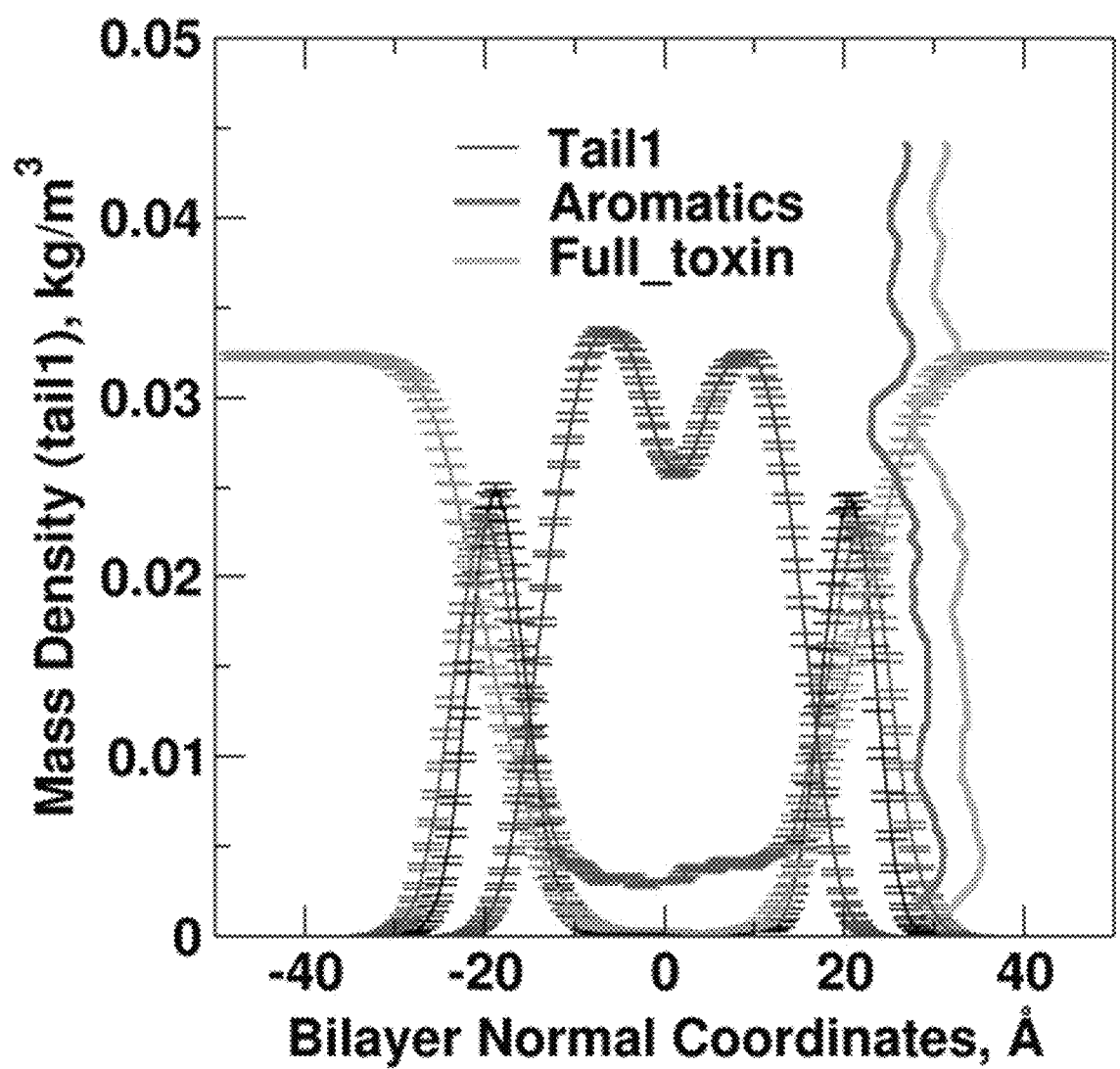
FIG. 13 shows a binding depth profile GxTx-1E/Kv1.2/2.1.

FIGS. 30A-J show a multiple alignment of the voltage sensing domain amino acid sequences. Designation 001 is the voltage sensing domain of Homo_hvcn1 gi_91992153_ (SEQ ID NO: 74); designation 002 is the voltage sensing domain of Gallus_hvcn gi_71897219_(SEQ ID NO: 75); designation 003 is the voltage sensing domain of opossum_hvcn gi_12632423_(SEQ ID NO: 76); designation 004 is the voltage sensing domain of rat_hvcn1 gi_109497399_(SEQ ID NO: 77); designation 005 is the voltage sensing domain of Equus_hvcn1 gi_194214323_ (SEQ ID NO: 78); designation 006 is the voltage sensing domain of bos_hvcn1 gi_119909285_(SEQ ID NO: 79); designation 007 is the voltage sensing domain of sus_hvcn1 gi_194042948_(SEQ ID NO: 80); designation 008 is the voltage sensing domain of Macaca_hvcn_4 gi_109098724_ (SEQ ID NO: 81); designation 009 is the voltage sensing domain of Macaca_hvcn gi_109098722_(SEQ ID NO: 82); designation 010 is the voltage sensing domain of Macaca_hvcn_2 gi_10909872_(SEQ ID NO: 83); designation 011 is the voltage sensing domain of dog_hvcn1_2 gi_73994604_(SEQ ID NO: 84); designation 012 is the voltage sensing domain of dog_hvcn1 gi_73994606_(SEQ ID NO: 85); designation 013 is the voltage sensing domain of mus_hvcn1 gi_109809757_(SEQ ID NO: 86); designation 014 is the voltage sensing domain of Xenopus_t_hvcn1 gi_58332220_(SEQ ID NO: 87); designation 015 is the voltage sensing domain of Xenopus_1_hvcn1 gi_148235789 148235(SEQ ID NO: 88); designation 016 is the voltage sensing domain of Danio_hvcn1 gi_50539752_(SEQ ID NO: 89); designation 017 is the voltage sensing domain of tetraodon_hvcn1 gi_47209646_(SEQ ID NO: 90); designation 018 is the voltage sensing domain of takifugu_hvcn1 ENSEMBL UPI00016E3E8E(SEQ ID NO: 91); designation 019 is the voltage sensing domain of nematostella_hvcn gi_156364735_(SEQ ID NO: 92); designation 020 is the voltage sensing domain of Ciona_hvcn gi_118344228_ (SEQ ID NO: 93); designation 021 is the voltage sensing domain of trichoplex_hvcn1 gi_196002093_(SEQ ID NO: 94); designation 022 is the voltage sensing domain of human_CACNA1E_repeat_3 gi_53832005_(SEQ ID NO: 95); designation 023 is the voltage sensing domain of Drosophila_CAC1A_repeat_3 gi_24641459_(SEQ ID NO: 96); designation 024 is the voltage sensing domain of mouse_CAC1H_repeat_1 gi_254826786_(SEQ ID NO: 97); designation 025 is the voltage sensing domain of Homo_CAC1I_repeat_1 gi_51093859_(SEQ ID NO: 98); designation 026 is the voltage sensing domain of Homo_CAC1G_repeat3 sp_O43497(SEQ ID NO: 99); designation 027 Gallus_SCN1A_repeat1 uniprot_E1C4S3 (SEQ ID NO: 100); designation 028 is the voltage sensing domain of rat_SCN2A_repeat1 sp_P04775(SEQ ID NO: 101); designation 029 is the voltage sensing domain of mouse_SCN1A_repeat1 uniprot_A2APX8(SEQ ID NO: 102); designation 030 is the voltage sensing domain of mouse_SCN1A_repeat1 uniprot_A2APX7(SEQ ID NO: 103); designation 031 is the voltage sensing domain of rat_SCN11A_repeat1 sp_O88457(SEQ ID NO: 104); designation 032 is the voltage sensing domain of mouse_SCN11A_repeat1 sp_Q9R053(SEQ ID NO: 105); designation 033 is the voltage sensing domain of Homo_SCN11A_repeat1 sp_Q9UI33(SEQ ID NO: 106); designation 034 is the voltage sensing domain of taeniopygia_SCN_repeat1 gi_224044620_(SEQ ID NO: 107); designation 035 is the voltage sensing domain of Homo_SCN4A_repeat1 sp_P35499(SEQ ID NO: 199); designation 036 is the voltage sensing domain of rat_SCN5A_repeat1 sp_P15389(SEQ ID NO: 108); designation 037 is the voltage sensing domain of rat_SCN9A_repeat1 sp_O08562(SEQ ID NO: 109); designation 038 is the voltage sensing domain of rabbit_SCN9A_repeat1 sp_Q28644(SEQ ID NO: 110); designation 039 is the voltage sensing domain of Homo_SNC3A_repeat1 sp_Q9NY46(SEQ ID NO: 111); designation 040 is the voltage sensing domain of Canis_SCN_repeat1 gi_74004456_(SEQ ID NO: 112); designation 041 is the voltage sensing domain of Danio_SCN8AA_repeat1 sp_Q9DF53(SEQ ID NO: 113); designation 042 is the voltage sensing domain of mouse_SCN8A_repeat1 sp_Q9WTU3(SEQ ID NO: 114); designation 043 is the voltage sensing domain of Canis_SCNAA_repeat1 sp_O46669(SEQ ID NO: 115); designation 044 is the voltage sensing domain of Homo_SCN7A_repeat1 sp_Q01118(SEQ ID NO: 116); designation 045 is the voltage sensing domain of rabbit_CAC1C_repeat1 sp_P15381(SEQ ID NO: 117); designation 046 is the voltage sensing domain of mouse_CAC1S_repeat1 sp_Q02789(SEQ ID NO: 118); designation 047 is the voltage sensing domain of mouse_CAC1F_repeat1 sp_Q9JIS7(SEQ ID NO: 119); designation 048 is the voltage sensing domain of Gallus_CAC1D_repeat1 sp 073700(SEQ ID NO: 120); designation 049 is the voltage sensing domain of Homo_CACN_repeat1 gi_193788728_(SEQ ID NO: 121); designation 050 is the voltage sensing domain of Drosophila_CAC1D_repeat1 sp_Q24270(SEQ ID NO: 122); designation 051 is the voltage sensing domain of Homo_CAC1A_repeat1 sp_O00555(SEQ ID NO: 123); designation 052 is the voltage sensing domain of Homo_CAC1B_repeat1 sp_Q00975(SEQ ID NO: 124); designation 053 is the voltage sensing domain of rat_SCN11A_repeat3 sp_O88457(SEQ ID NO: 125); designation 054 is the voltage sensing domain of mouse_SCN11A_repeat3 sp_Q9R053(SEQ ID NO: 126); designation 055 is the voltage sensing domain of rat_SCN9A_repeat3 sp_O08562(SEQ ID NO: 127); designation 056 is the voltage sensing domain of rabbit_SCN9A_repeat3 sp_Q28644(SEQ ID NO: 128); designation 057 is the voltage sensing domain of mouse_SCN9A_repeat3 uniprot_B7ZWN(SEQ ID NO: 129); designation 058 is the voltage sensing domain of mouse_KCNH1 sp_Q60603(SEQ ID NO: 130); designation 059 is the voltage sensing domain of mouse_KCNH8 sp_P59111(SEQ ID NO: 131); designation 060 is the voltage sensing domain of Homo_KCNH3 sp_Q9ULD8(SEQ ID NO: 132); designation 061 is the voltage sensing domain of Homo_CAC1G_repeat4 sp_O43497(SEQ ID NO: 133); designation 062 is the voltage sensing domain of mouse_SCN11A_repeat4 sp_Q9R053(SEQ ID NO: 134); designation 063 is the voltage sensing domain of rat_SCN9A_repeat4 sp_O08562(SEQ ID NO: 135); designation 064 is the voltage sensing domain of rat_SCN11A_repeat4 sp_O88457(SEQ ID NO: 136); designation 065 is the voltage sensing domain of humo_CAC1G_repeat2 sp_O43497(SEQ ID NO: 137); designation 066 is the voltage sensing domain of Homo_CACNA1E_repeat_4 sp_Q15878(SEQ ID NO: 138); designation 067 is the voltage sensing domain of Drosophila_CAC1A_repeat_4 sp_P91645(SEQ ID NO: 139); designation 068 is the voltage sensing domain of Homo_KCNV2 sp_Q8TDN2(SEQ ID NO: 140); designation 069 is the voltage sensing domain of Homo_KCNF1 sp_Q9H3M0_KCNF1(SEQ ID NO: 141); designation 070 is the voltage sensing domain of Homo_KCNB1 sp_Q14721 (SEQ ID NO: 142); designation 071 is the voltage sensing domain of Canis_KCNB2 sp_Q95167(SEQ ID NO: 143); designation 072 is the voltage sensing domain of Drosophila_KCNAB sp_P17970(SEQ ID NO: 144); designation 073 is the voltage sensing domain of pongo_KCNV1 sp_Q5RC10(SEQ ID NO: 145); designation 074 is the voltage sensing domain of Homo_KCNS3 sp_Q9BQ31 (SEQ ID NO: 146); designation 075 is the voltage sensing domain of squirrelmonkey_KCNS1 sp A4K2X4(SEQ ID NO: 147); designation 076 is the voltage sensing domain of Gallus_KCNG2 sp_O73606(SEQ ID NO: 148); designation 077 is the voltage sensing domain of Homo_KCNG4 sp_Q8TDN1(SEQ ID NO: 149); designation 078 is the voltage sensing domain of rat_KCNC3 sp_Q01956_KCNC3 (SEQ ID NO: 150); designation 079 is the voltage sensing domain of Homo_KCNC2 sp_Q96PR1(SEQ ID NO: 151); designation 080 is the voltage sensing domain of Drosophila_KCNAW sp_P17972(SEQ ID NO: 152); designation 081 is the voltage sensing domain of Homo_KCNA1 sp_Q09470(SEQ ID NO: 153); designation 082 is the voltage sensing domain of rat KNCA6 sp_P17659(SEQ ID NO: 154); designation 083 is the voltage sensing domain of Homo_KCNA5 sp_P22460(SEQ ID NO: 155); designation 084 is the voltage sensing domain of rat_KCNA3 sp_P15384(SEQ ID NO: 156); designation 085 is the voltage sensing domain of Canis_Kv1.3 gi_57088651_(SEQ ID NO: 157); designation 086 is the voltage sensing domain of bovine_KCNA4 sp_Q05037(SEQ ID NO: 158); designation 087 is the voltage sensing domain of Homo_KCA10 sp_Q16322(SEQ ID NO: 159); designation 088 is the voltage sensing domain of rat_Kv1.2 2R9R_b_vs gi_16087779_ (SEQ ID NO: 160); designation 089 is the voltage sensing domain of Homo_Kv gi_4826782_(SEQ ID NO: 161); designation 090 is the voltage sensing domain of rat_Kv pdb:2A79_chainb(SEQ ID NO: 162); designation 091 is the voltage sensing domain of Canis_KCNA2 sp_Q28293(SEQ ID NO: 163); designation 092 is the voltage sensing domain of Drosophila_shaker_Kchannel gi_288442_(SEQ ID NO: 164); designation 093 rabbit_KCND3 sp_Q9TTT5(SEQ ID NO: 165); designation 094 is the voltage sensing domain of hum_CACNA1E_repeat_2 sp_Q15878(SEQ ID NO: 166); designation 095 is the voltage sensing domain of Drosophila_CAC1A_repeat_2 sp_P91645(SEQ ID NO: 167); designation 096 is the voltage sensing domain of mouse_SCN11A_repeat2 sp_Q9R053(SEQ ID NO: 168); designation 097 is the voltage sensing domain of rat_SCN11A_repeat2 sp_O88457(SEQ ID NO: 169); designation 098 is the voltage sensing domain of rat_SCN9A_repeat2 sp_O08562(SEQ ID NO: 170); designation 099 is the voltage sensing domain of ornitho_C15orf27_gi_149410687 (SEQ ID NO: 171); designation 100 is the voltage sensing domain of Danio_c15orf27 gi_123703002_(SEQ ID NO: 172); designation 101 is the voltage sensing domain of monodelphis_C15orf27 gi_12627230_(SEQ ID NO: 173); designation 102 is the voltage sensing domain of sus_C15orf27 gi_194039682_(SEQ ID NO: 174); designation 103 is the voltage sensing domain of Homo_C15orf27 gi_118442841_(SEQ ID NO: 175); designation 104 is the voltage sensing domain of pan_C15orf27_gi_114658268_ (SEQ ID NO: 176); designation 105 is the voltage sensing domain of horse_C15orf27_gi_149692210_(SEQ ID NO: 177); designation 106 is the voltage sensing domain of mus_C15orf27 gi_27370422_(SEQ ID NO: 178); designation 107 is the voltage sensing domain of rat_C15or27 gi_157817759_(SEQ ID NO: 179); designation 108 is the voltage sensing domain of Ciona_C15orf gi_198433556_ (SEQ ID NO: 180); designation 109 is the voltage sensing domain of Methanococcus_hyperpol_Kv sp_Q57603(SEQ ID NO: 181); designation 110 is the voltage sensing domain of ornitho_vsp gi_149635858_(SEQ ID NO: 182); designation 111 is the voltage sensing domain of Xenopus_t_vsp gi_62859843_(SEQ ID NO: 183); designation 112 is the voltage sensing domain of Gallus_vsp gi_118084924_(SEQ ID NO: 184); designation 113 is the voltage sensing domain of Danio_vsp gi_70887553_(SEQ ID NO: 185); designation 114 is the voltage sensing domain of Xenopus_vsp gi_148230800_(SEQ ID NO: 186); designation 115 is the voltage sensing domain of rat_vsp gi_157820295_(SEQ ID NO: 187); designation 116 is the voltage sensing domain of mus_vsp gi_40549440_(SEQ ID NO: 188); designation 117 is the voltage sensing domain of dog_vsp gi_73993164_ (SEQ ID NO: 189); designation 118 is the voltage sensing domain of human_vsp gi_213972591_(SEQ ID NO: 190); designation 119 is the voltage sensing domain of Homo_vsp_gamma gi_40549435_(SEQ ID NO: 191); designation 120 is the voltage sensing domain of Ciona_vsp gi_76253898_(SEQ ID NO: 192); designation 121 is the voltage sensing domain of Aeropyrum_Kv PDB_1ORS_c (SEQ ID NO: 201); designation 122 is the voltage sensing domain of Homo_BK gi_119574982_(SEQ ID NO: 193); designation 123 is the voltage sensing domain of mouse_B-K_mslo gi_4639628_(SEQ ID NO: 194).

FIG. 31 shows the amino acid sequences of CiVSP voltage-sensor containing phosphatase [Ciona intestinalis] (GenBank: BAD98733.1) (SEQ ID NO. 195); DrVSP voltage-sensing phosphoinositide phosphatase [Danio rerio] GenBank: BAG50379.1 (SEQ ID NO. 196); TPIP alpha lipid phosphatase [Homo sapiens] GenBank: CAD13144.1 (SEQ ID NO. 197); TPTE2 Phosphatidylinositol-3,4,5-triphosphate 3-phosphatase [Homo sapiens] Uniprot: Q6XPS3 (SEQ ID NO: 198)

FIGS. 32A-C show a multiple sequence alignment of the amino acid sequences of human Kv2.1 (SEQ ID NO: 29); CiVSP voltage-sensor containing phosphatase [Ciona intestinalis](GenBank: BAD98733.1) (SEQ ID NO. 195); DrVSP voltage-sensing phosphoinositide phosphatase [Danio rerio] GenBank: BAG50379.1 (SEQ ID NO. 196); TPIP alpha lipid phosphatase [Homo sapiens] GenBank: CAD13144.1 (SEQ ID NO. 197); TPTE2 Phosphatidylinositol-3,4,5-triphosphate 3-phosphatase [Homo sapiens] Uniprot: Q6XPS3 (residues 1-518 of SEQ ID NO: 198); TPTE (SEQ ID NO: 202); and Shaker (SEQ ID NO: 203).

FIGS. 33A-D show the I/V relationships of WT (A), R1S (C). Currents were normalized to the maximal current at +60 mV (mean data from 7 oocytes (A) and 4 oocytes (C)). Normalized current amplitudes at given voltages are shown as mean values±S.E. (hidden by symbols). Typical potassium outward currents through WT (B) and mutant R1S (D) channels are illustrated on the right panel. The insets display the corresponding voltage protocols and holding potentials.

FIGS. 34A-D. The I/V curve shows that Iω are not present in WT Shaker (A). Test pulses were applied from +60 mV to −300 mV (illustrated in B). Currents were normalized to the maximal current at +60 mV (data from 7 oocytes). Normalized current amplitudes at given voltages are shown as mean values±S.E. (hidden by symbols). Typical potassium outward currents through WT (C) are illustrated on the lower panel. Same experiment at higher resolution is shown in (D) illustrating an unspecific inward conductance developing at pulses negative to −260 mV (see also mean values in A at −280 and −300 mV).

FIGS. 35A-D. The I/V curve shows that Iω is present in R1 S and that this current is blocked by $La^{3+}$ (A). Test pulses were applied from +60 mV to −300 mV (same voltage steps as in FIG. 34B applied from a holding potential of −50 mV). Currents were normalized to the maximal current at +60 mV. Control R1 S I/V curve (squares) and I/V curves in the presence of 30 (circles), 100 (triangles) and 300 μM $La^{3+}$ (diamonds) are shown (data from 4 oocytes). Normalized current amplitudes at given voltages are shown as mean values±S.E. Typical potassium outward currents through R1 S and omega currents in control (B) and in the presence of 30 μM (C) and 300 μM $La^{3+}$ (D) are illustrated.

FIGS. 36A-D. The I/V curve shows that Iω is present in R1S/W434F (A). Test pulses were applied from +60 mV to −300 mV (same voltage protocol as in FIG. 34 B). Current amplitudes at given voltages are shown as mean values±S.E (data from 6 oocytes). (B) and (C) illustrate the absence of outward currents and at a higher resolution (C) the presence of omega currents in construct R1 S/W434F. (D) Iω was induced by voltage steps from a holding potential of −80 mV to −200 mV (see inset). Inhibition of Iω induced by 100 μM $La^{3+}$ occurred in a "use-dependent" manner. The lower trace (control, in the absence of $La^{3+}$) is superimposed by twenty currents during 20 ms pulses applied at a frequency of 1 Hz.

FIGS. 37A-H show the I/V relationships of various Kv2.1 channels constructs expressed in Xenopus oocytes injected with the corresponding cRNAs: WT (A), R0N (B), R2S (C), R0C/R2S (D), R-1S/R0S (E), R-1S/R0C (F), R-1S/R0S/R2S (G) and R-1S/R0C/R2S (H) Kv2.1 channel constructs expressed in Xenopus oocytes are illustrated. Currents were normalized to the maximal current at +60 mV (data from 9 (A), 7 (B), 6 (C), 4 (D), 8 (E), 4 (F), 7 (G) and 4 oocytes (H)). Normalized current amplitudes at given voltages are shown as mean values±S.E. (hidden by symbols).

FIGS. 38A-H show the typical potassium outward currents though the designated channel constructs: WT (A), R0N (B), R2S (C), R0C/R2S (D), R-1S/R0S (E), R-1S/R0C (F), R-1S/R0S/R2S (G) and R-1S/R0C/R2S (H).

Figure 39:
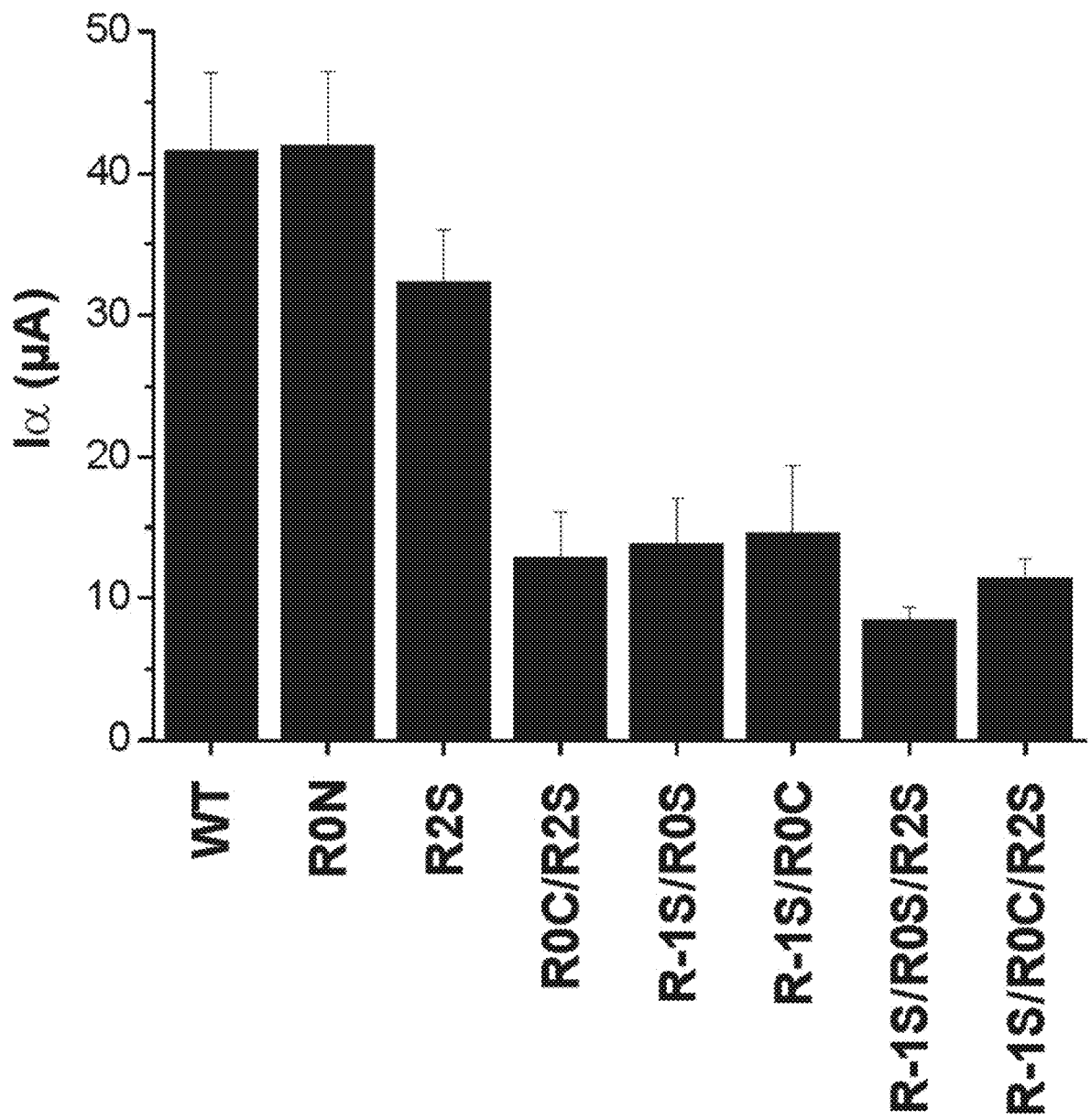

FIG. 39 shows the mean maximal outward currents at +60 mV through the designated Kv2.1 constructs (in μA; two batches, 3).

FIGS. 40A-F show the I/V relationships for Kv2.1 channels in the absence and presence of AgTx2. WT (A) and R2S (D) channels are shown in the absence (control, squares) and presence of 1 nM AgTx2 (circles). Peak currents were normalized to the maximal current at +60 mV. Normalized peak current amplitudes at given voltages are shown as mean values±S.E. (hidden by symbols). The mean inhibition of the maximal outward current at +60 mV amounted 66.5±2.9% (n=4, WT) and 67.8±2.8% (n=5, R2S). Typical potassium outward currents through WT and R2S Kv2.1 channels in control (B, E) and in the presence of 1 nM AgTx2 (C, F) are illustrated respectively.

Figure 41:
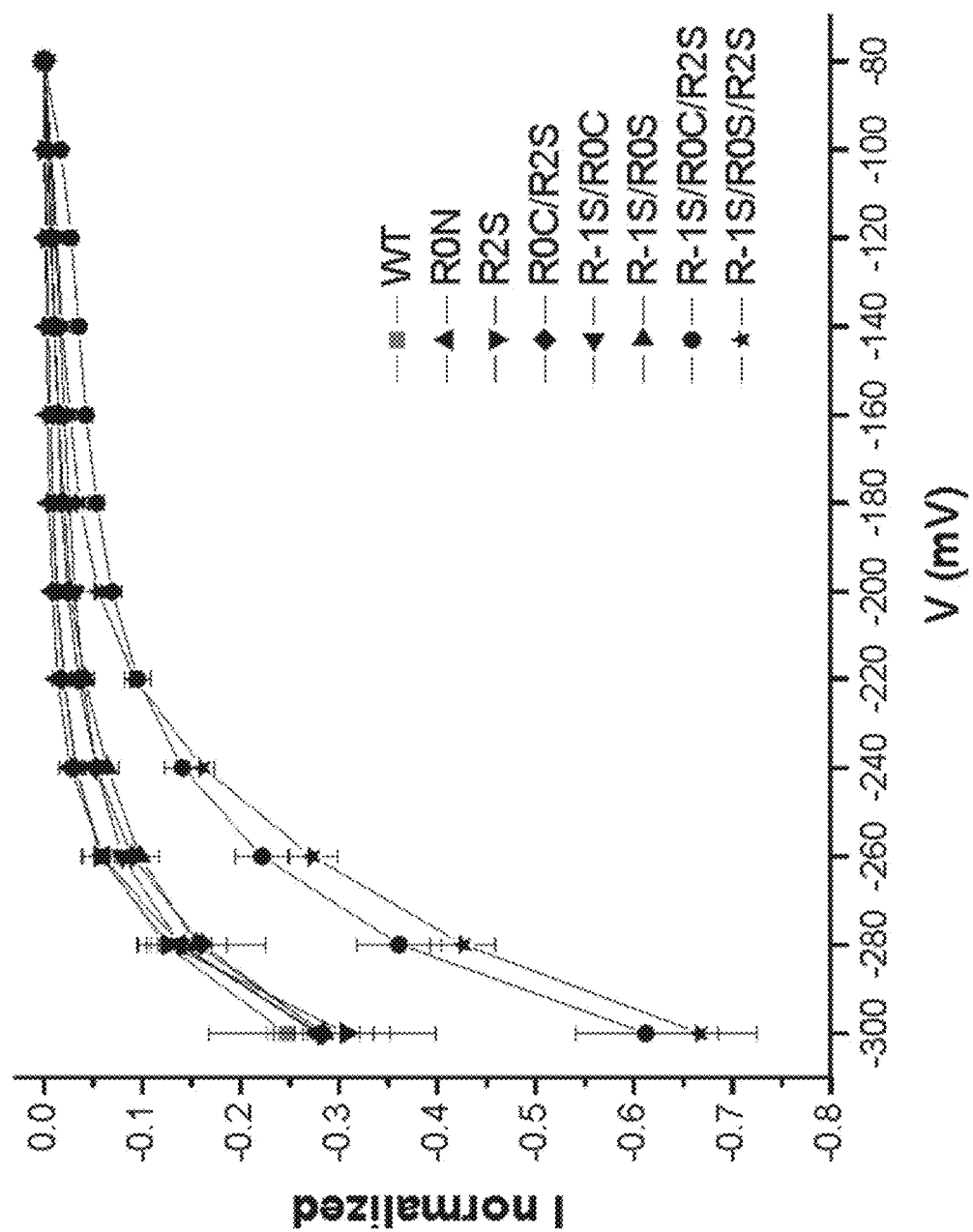

FIG. 41 shows current-voltage relationships of WT, R0N, R2S, R0C/R2S, R-1S/R0C, R-1S/R0S, R-1S/R0C/R2S and R-1S/R0S/R2S Kv2.1 channel constructs normalized to maximal outward current at +60 mV. Inward currents were recorded during 10 ms hyperpolarising voltage steps from a holding potential of −80 mV to −300 mV (20 mV steps) in Xenopus oocytes injected with the corresponding cRNAs. Normalized current amplitudes at given voltages are shown as mean values±S.E. (n≥4, two batches of oocytes). Currents were not leak subtracted.

Figure 42:
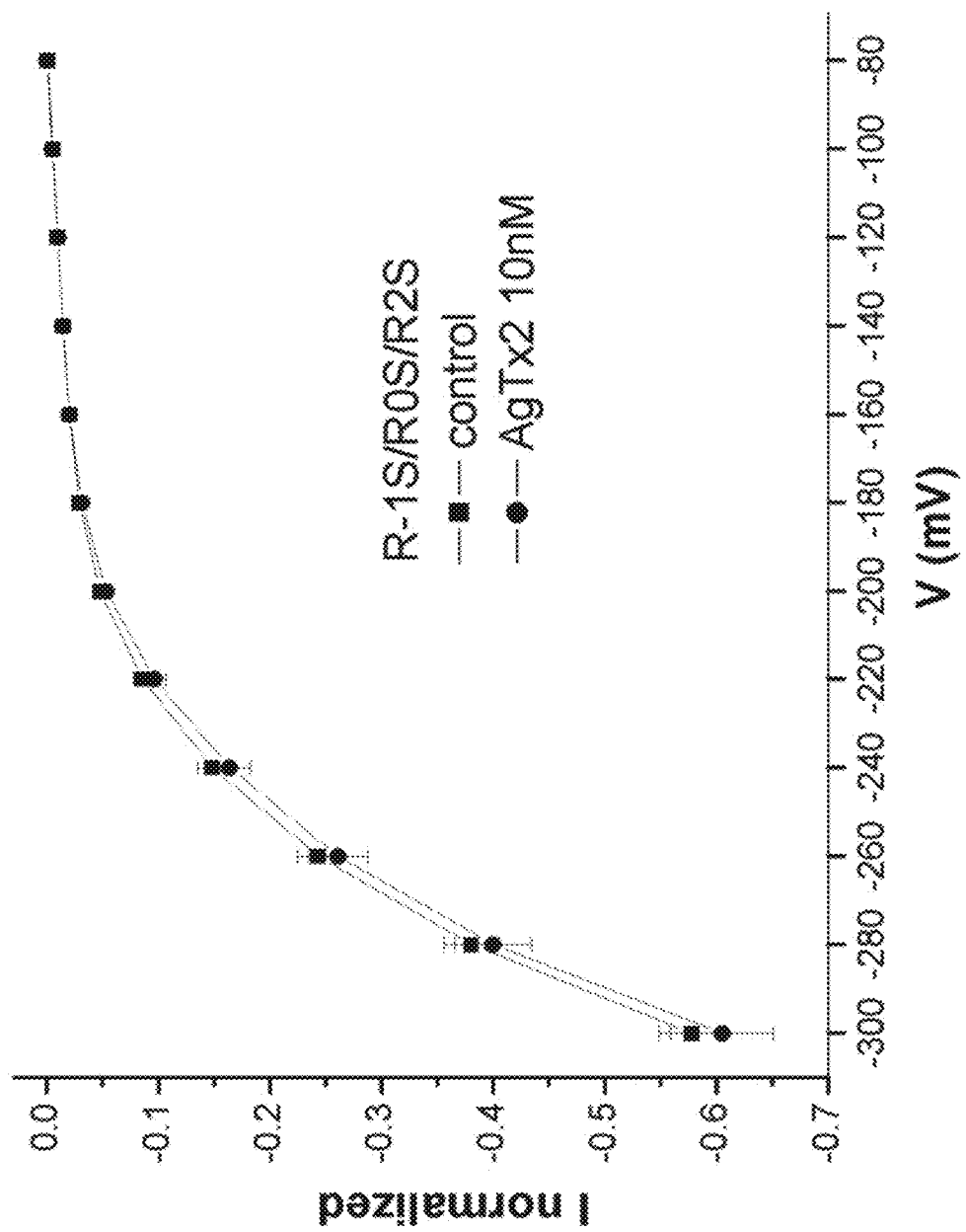

FIG. 42 shows the inward current-voltage relationships of Kv2.1 construct R-1S/R0S/R2S in the absence (control, squares) and after 5 minutes in the presence of 10 nM AgTx2 (filled circles). Inward currents after 5 ms were normalized to the maximal outward current at +60 mV. Normalized inward current amplitudes at given voltages are shown as mean values±S.E. (n≥4, two batches of oocytes).

FIGS. 43A-C. (A) illustrates the inward current-voltage relationships of construct R-1S/R0S/R2S in the absence (control; squares) and in the presence of the indicated concentrations of $La^{3+}$ (other symbols). Inward currents after 5 ms in control and $La^{3+}$ were normalized to the maximal outward current at +60 mV. Normalized inward current amplitudes at given voltages are shown as mean values±S.E. (n≥4, two batches of oocytes). (B, C) illustrate typical inward currents during hyperpolarizing pulses through R-1 S/R0S/R2S in the absence (B) and in the presence of 10 mM $La^{3+}$ (C).

FIGS. 44A-B. (A) illustrates the concentration-dependent inhibition of the inward currents after 5 ms (normalized to control) through R-1 S/R0S/R2S at −300 mV. The concentration-inhibition curve was fitted to the Hill equation. (B) illustrates superimposed inward currents at −300 mV in the absence and in the presence of 30 μM, 100 μM, 300 μM, 1 mM, 3 mM and 10 mM $La^{3+}$. A half-maximal inhibition concentration (IC50) of 785±419 µM was estimated (nH=0.8±0.1; n≥4, two batches of oocytes).

Figure 45:
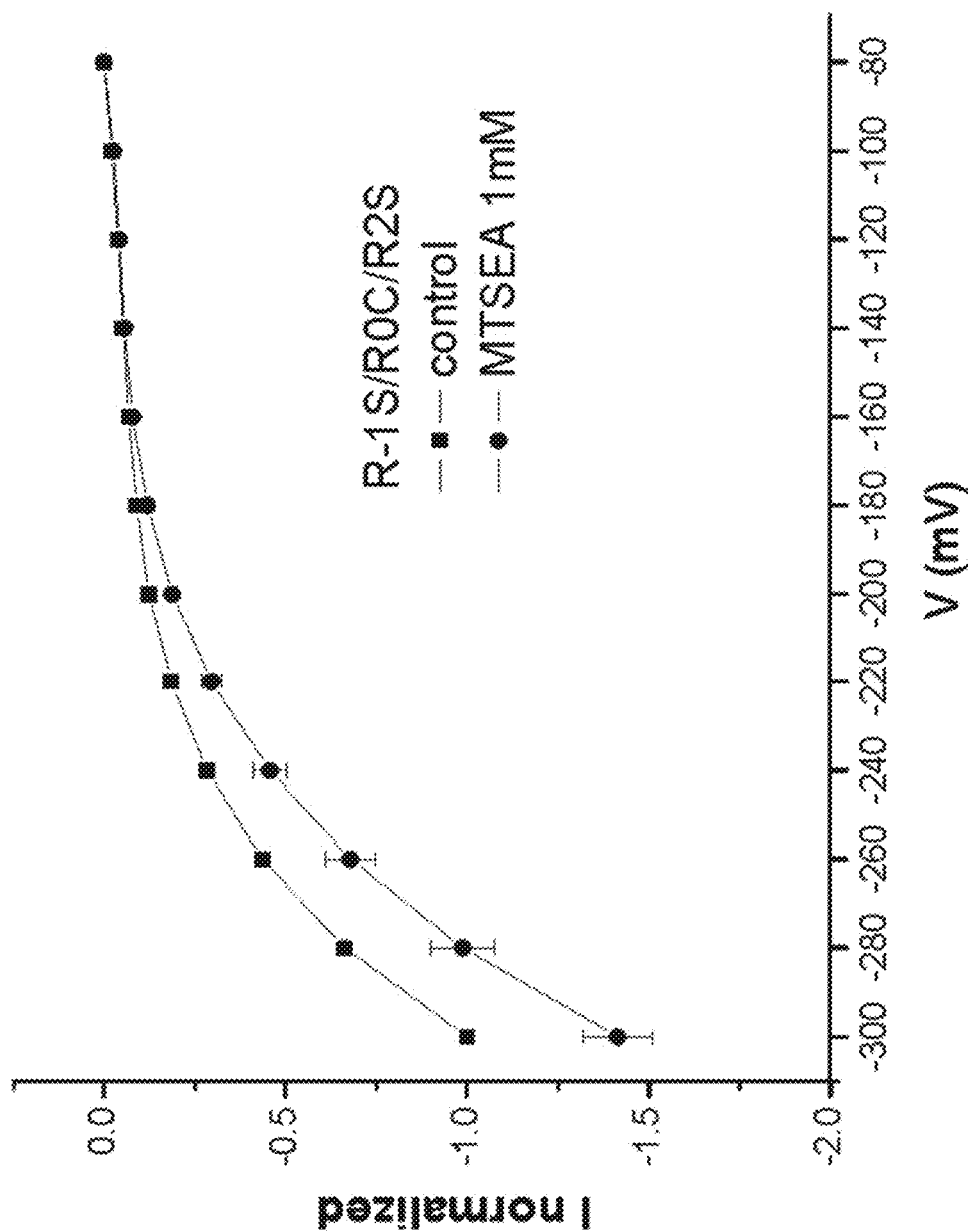

FIG. 45 shows the inward current-voltage relationships of Kv2.1 mutant R-1S/R0C/R2S in the absence of (squares) and after 5 minutes application of 1 mM MTSEA (filled circles). Inward currents after 5 ms in the absence of reagent or in the presence of the MTSEA, MTSES, or MTSET reagents were normalized to the inward current at −300 mV in the absence of reagent. Normalized inward current amplitudes at the indicated voltages are shown as mean values±S.E. (n≥4, two batches of oocytes).

Figure 46:
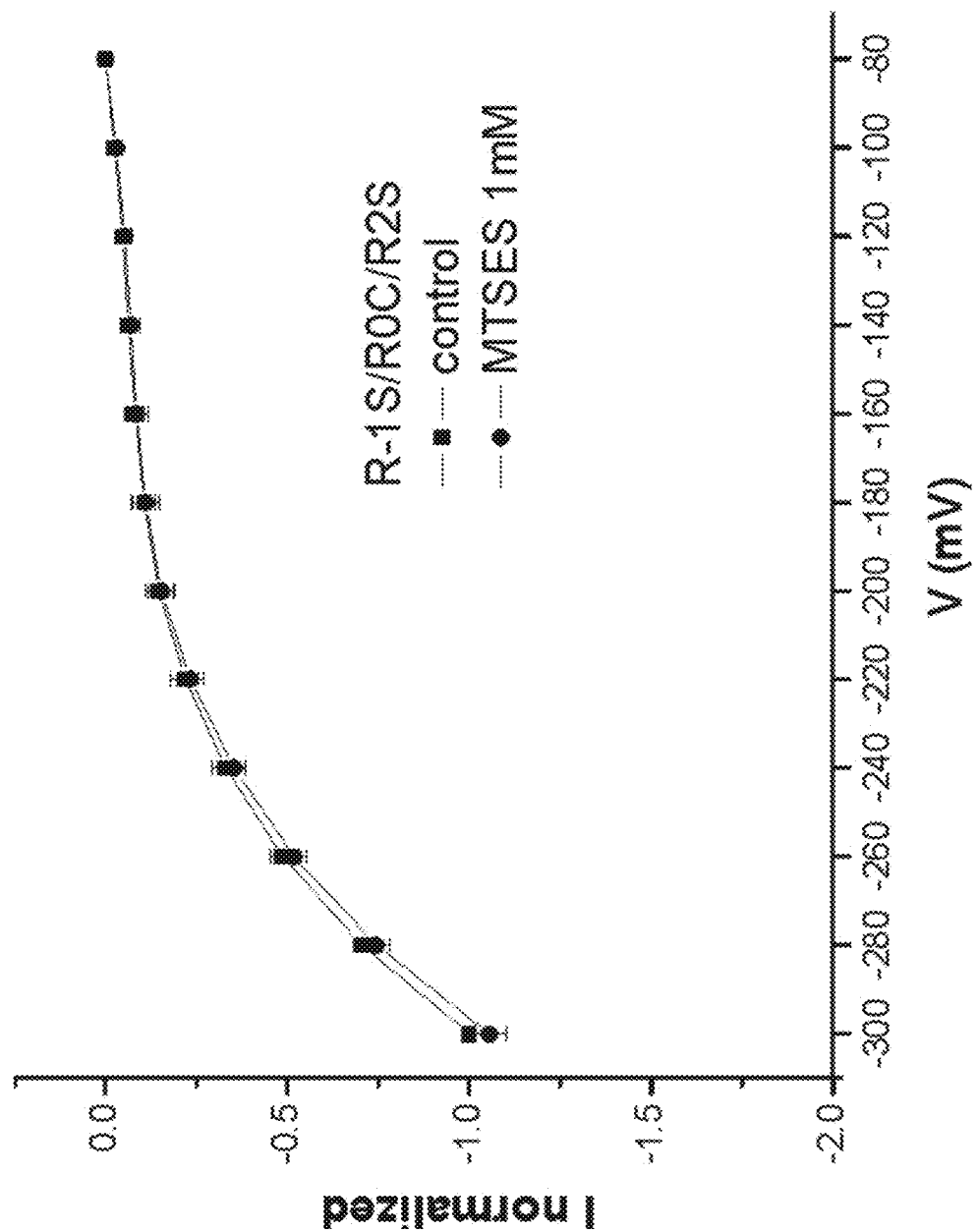

FIG. 46 shows the inward current-voltage relationships of Kv2.1 mutant R-1S/R0C/R2S in the absence of (squares) and after 5 minutes application of 1 mM MTSES (filled circles). Inward currents after 5 ms in the absence of reagent or in the presence of the MTSEA, MTSES, or MTSET reagents were normalized to the inward current at −300 mV in the absence of reagent. Normalized inward current amplitudes at the indicated voltages are shown as mean values±S.E. (n≥4, two batches of oocytes).

Figure 47:
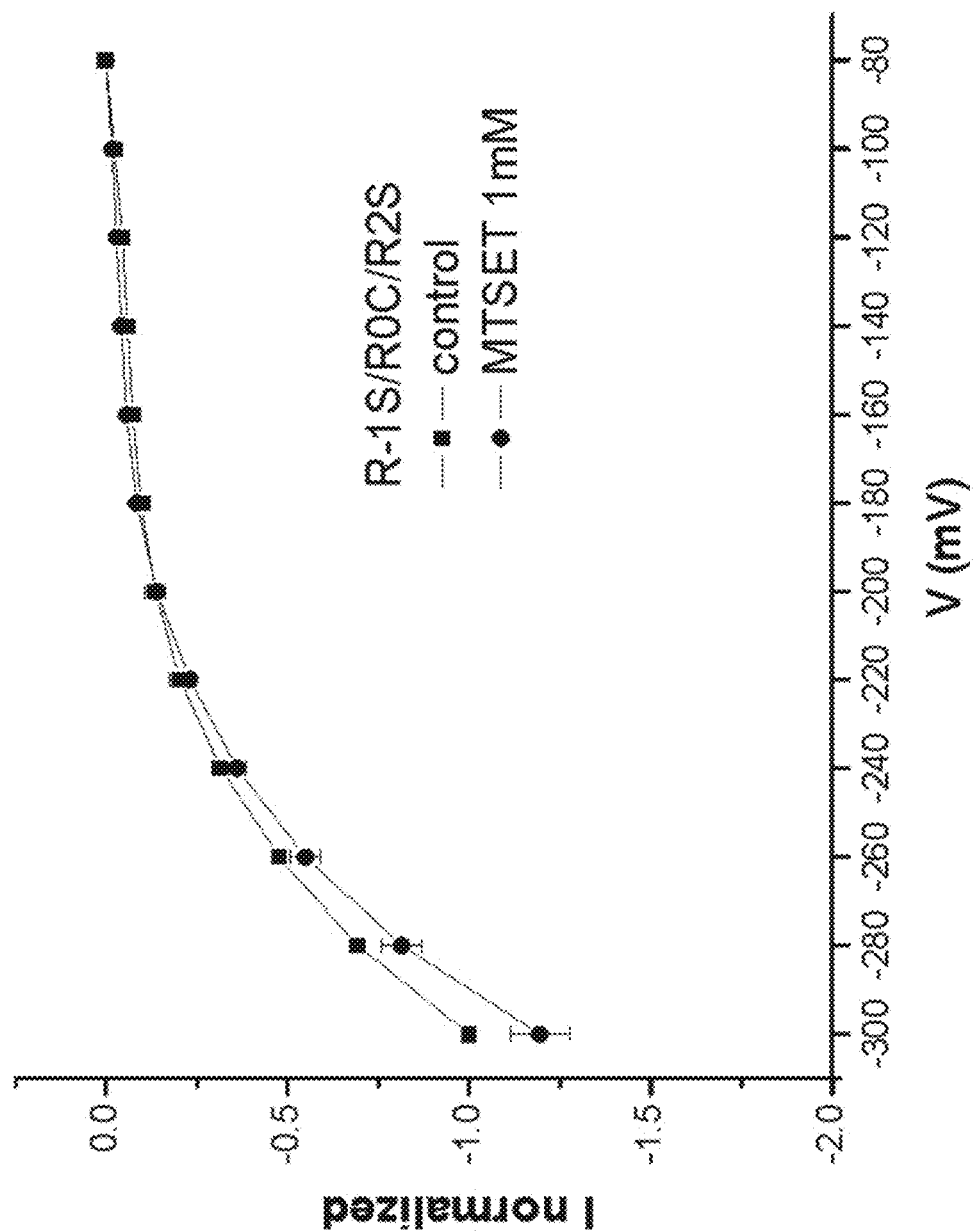

FIG. 47 shows the inward current-voltage relationships of Kv2.1 mutant R-1S/R0C/R2S in control (squares) and after 5 minutes application of 1 mM MTSET (filled circles). Inward currents after 5 ms in the absence of reagent or in the presence of the MTSEA, MTSES, or MTSET reagents were normalized to the inward current at −300 mV in the absence of reagent. Normalized inward current amplitudes at the indicated voltages are shown as mean values±S.E. (n≥4, two batches of oocytes).

FIG. 48 shows alignment of the Shaker (residues 357-386 of SEQ ID NO: 1) and Kv2.1 (residues 292-321 of SEQ ID NO: 29).

FIGS. 49A-B. (A) illustrates the inward current-voltage relationships of Iω of Kv2.1 R-1 S/R0S/R2S in the absence of (squares) and after 5 minutes application of 100 nM GxTx-1E (circles). Inward currents after 5 ms were normalized to the inward current at −300 mV in the control. Normalized inward current amplitudes at the indicated voltages are given as mean values±S.E. (B) illustrates typical inward currents during hyperpolarizing pulses through R-1S/R0S/R2S in the absence of (left) and in the presence of 100 nM GxTx-1E (right).

Figure 50:
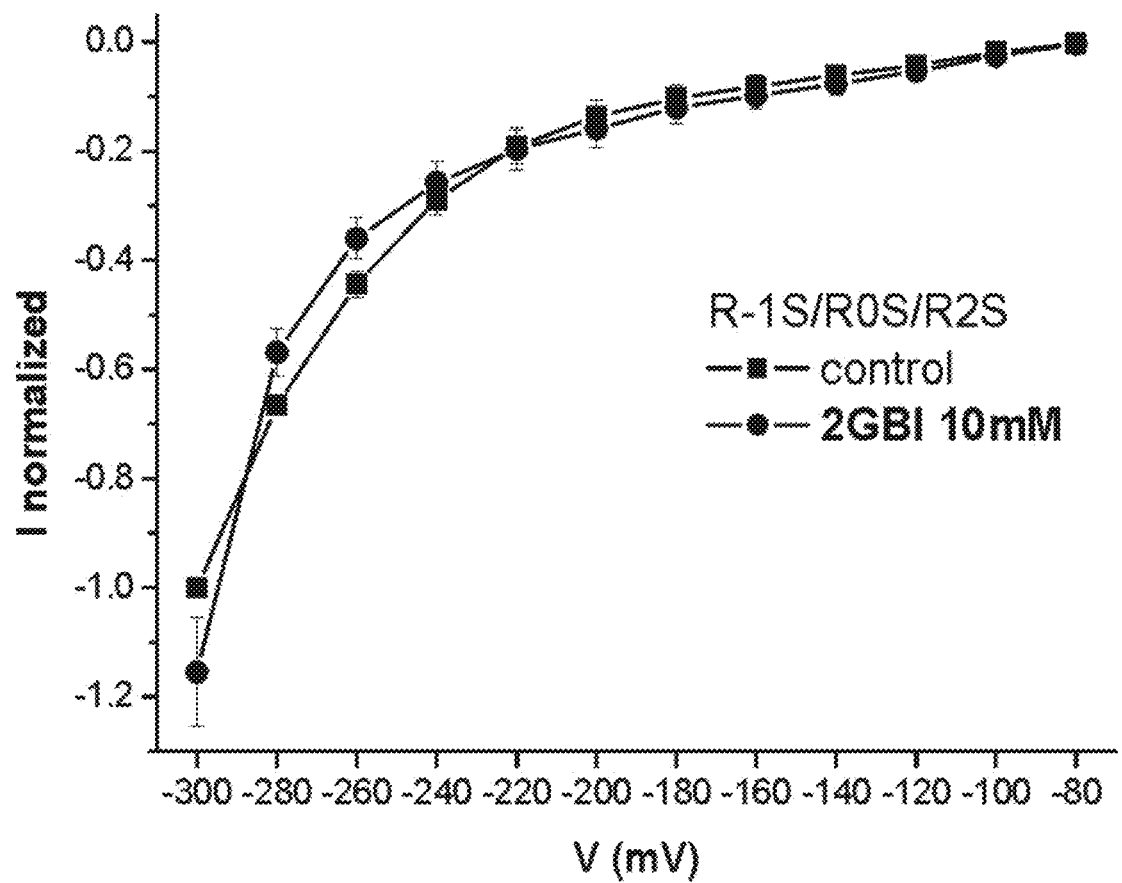

FIG. 50 shows the inward current-voltage relationships of Iω of Kv2.1 R-1S/R0S/R2S in the absence of (squares) and after 5 minutes application of 10 mM 2GBI (circles). Inward currents after 5 ms in control and 2GBI were normalized to the inward current at −300 mV in the control. Normalized inward current amplitudes at the indicated voltages are given as mean values±S.E.

Figure 51:
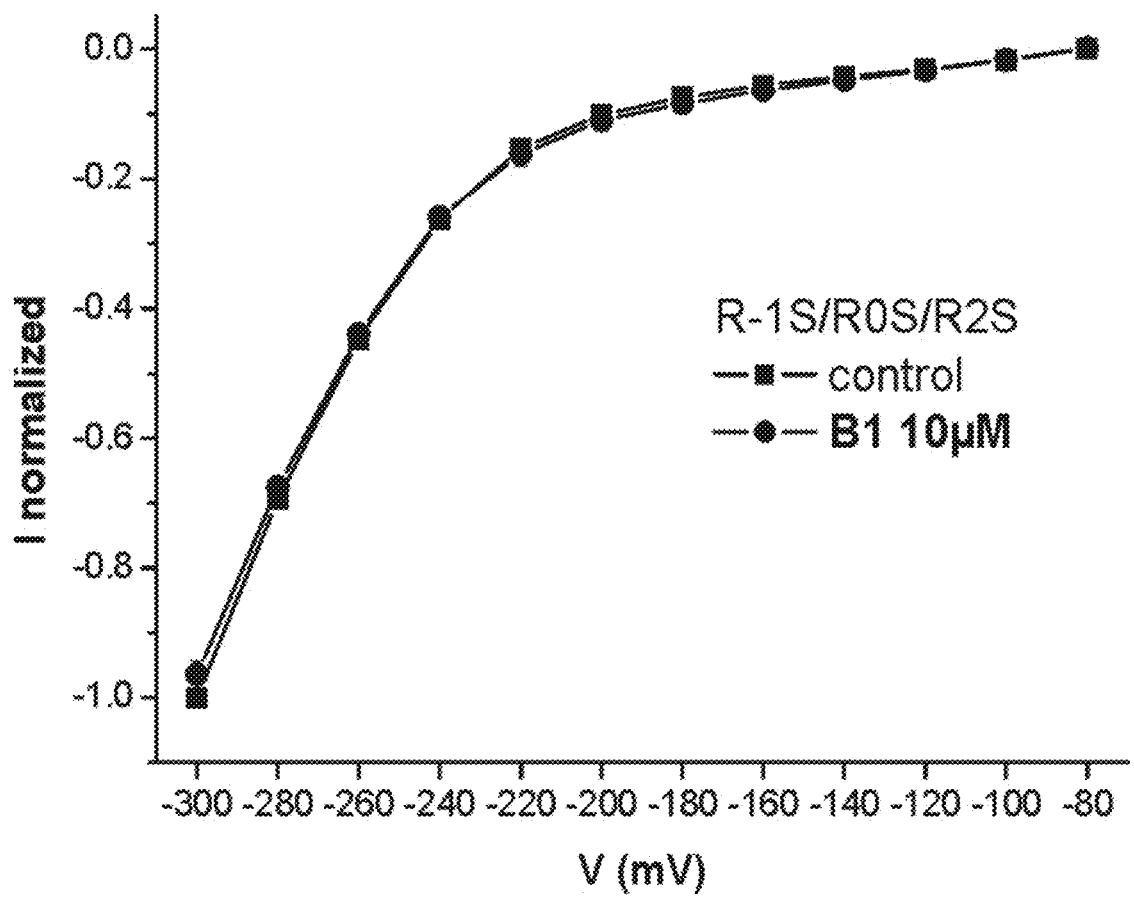

FIG. 51 shows the inward current-voltage relationships of Iω of Kv2.1 R-1S/R0S/R2S in the absence of (squares) and after 5 minutes application of 10 µM B1 (circles). Inward currents after 5 ms in control and B1 were normalized to the inward current at −300 mV in the control. Normalized inward current amplitudes at the indicated voltages are given as mean values±S.E.

Figure 52:
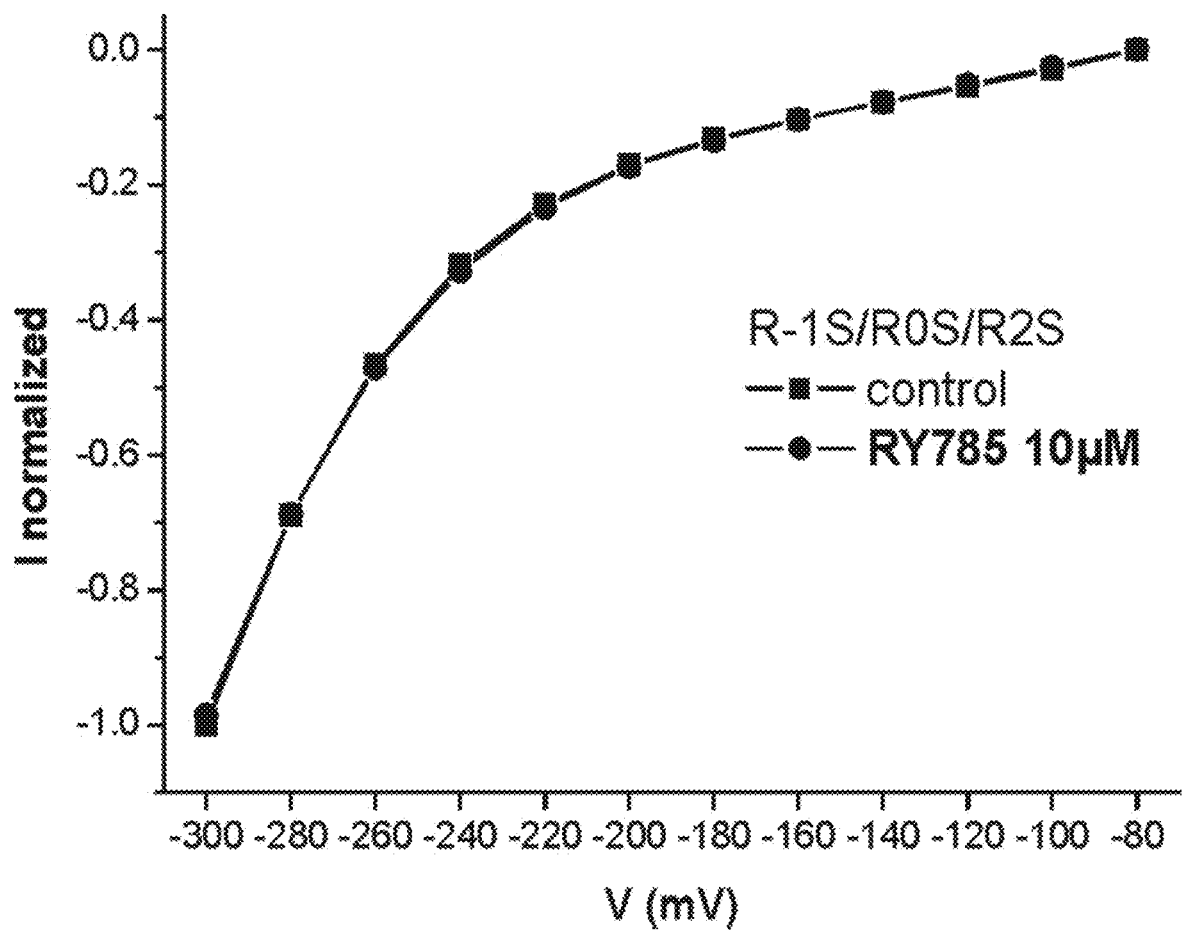

FIG. 52 shows the inward current-voltage relationships of Iω of Kv2.1 R-1S/R0S/R2S in the absence of (squares) and after 5 minutes application of 10 µM RY785 (circles). Inward currents after 5 ms in control and RY785 were normalized to the inward current at −300 mV in the control. Normalized inward current amplitudes at the indicated voltages are given as mean values±S.E.

FIGS. 53A-C show a multiple sequence alignment of the amino acid sequences of *Drosophila* Shaker (SEQ ID NO:1), human Kv2.1 (SEQ ID NO: 29); CiVSP voltage-sensor containing phosphatase [*Ciona intestinalis*](GenBank: BAD98733.1) (SEQ ID NO. 195); DrVSP voltage-sensing phosphoinositide phosphatase [*Danio rerio*] GenBank: BAG50379.1 (SEQ ID NO. 196); TPIP alpha lipid phosphatase [*Homo sapiens*] GenBank: CAD13144.1 (SEQ ID NO. 197); TPTE2 Phosphatidylinositol-3,4,5-triphosphate 3-phosphatase [*Homo sapiens*] Uniprot: Q6XPS3 (SEQ ID NO: 198)

DETAILED DESCRIPTION OF THE INVENTION

The issued patents, applications, and other publications that are cited herein are hereby incorporated by reference to the same extent as if each was specifically and individually indicated to be incorporated by reference.

Described herein are methods for identifying compounds that interact with VGPs and modulate their ionic conductance or enzymatic activity or other functional property, and/or change the distribution of their functional and/or conformational states. In certain aspects, the invention relates to methods for identifying compounds capable of modulating the activity of one or more types of voltage-gated proteins. The methods described herein can be use alone or in conjunction with any other screening methods known in the art and can be used in connection with other methods known in the art to identify compounds, mutations, biological mechanisms or therapeutic treatments, including, but not limited to those methods that employ combinatorial chemistry, molecular biology, high throughput screening, structure-based drug design, in vitro, in-vivo, in-silico methods, and the like.

Definitions

The singular forms "a," "an," and "the" include plural reference unless the context clearly dictates otherwise.

The term "about" is used herein to mean approximately, in the region of, roughly, or around. When the term "about" is used in conjunction with a numerical range, it modifies that range by extending the boundaries above and below the numerical values set forth. In general, the term "about" is used herein to modify a numerical value above and below the stated value by a variance of 20%.

As used herein, the term Voltage-Gated Protein (VGP) refers to a protein comprising a domain capable of sensing a voltage (e.g., a voltage sensing domain). Many such VGPs are known in the art and can be used in connection with the methods described herein. Examples of VGPs suitable for use with the methods described herein include, but are not limited to proteins that form ion channels, for example, voltage-gated ion channel (VGIC) proteins, as well proteins that do not form ion channels, for example voltage sensing phosphatase proteins (VSP).

Examples of VSPs suitable for used with the methods described herein include, but are not limited to CiVSPs, and TPTE proteins. VGICs are a superfamily comprising at least four major families of ion channels, each of which have functionally relevant sequence similarity as well as a varying degree of functional similarity. VGICs are also classified by the type of ions that pass through the channels, including potassium channels, calcium channels, sodium channels, and proton channels. Other types of channels include protein channels, chloride channels, and water channels (aquaporins). Thus, as used herein the term VGIC can refer to a voltage-gated potassium channel (VGPC), a voltage-gated calcium channel (VGCC), a voltage-gated sodium channel (VGSC), a voltage-gated proton channel (VGHC), or a voltage activated phosphatase (CiVSP). In certain embodiments, the term VGP, VGIC or VSP refers to a human VGP, VGIC or VSP protein however the use of the terms VGP, VGIC or VSP is not intended to be limited and encompass non-human orthologues and homologues found in other species, including insect and worm species. Where insect or worm VGPs are used in connection with the methods described herein, compounds identified using the methods described herein can, in certain embodiments, be useful as pesticides or toxins. VGPs from non-human sources suitable for use with the methods also include, but are not limited to, UniProtKB/Swiss-Prot: Q4W8A1; F6XHE4; F6XHF1; E1BUX1; F6LWC2; F1QG29; Q4V9E4; B3IUN7; G1NQ81; A8WGV0; A8WGV0; Q4KLP3; G3QBH0; Q4SFW2; F7DBU7; F6X178; G3TRR6; G1KSZ1; F7DBQ4; F1P987; G1LZ63; Q3KNE1; G5E8H5; E9Q3G1; G1TEB2; Q91X03; Q91X02, or variants, homologues or orthologues thereof.

One of skill in the art will appreciate that because VGPs are evolutionarily conserved among species, functionally related homologues of human VGPs exist in other species. A functional relationship between homologous proteins can be indicated in a number of ways, including, but not limited to: (a) the degree of sequence identity; and/or (b) the same or similar biological function. Homology can be determined using software programs readily available in the art, such as those discussed in Current Protocols in Molecular Biology (F. M. Ausubel et al., eds., 1987). Methods for identifying sequence identity between proteins and functional identity between amino acids between two or more VGP sequences are well known in the art, and include BLAST alignment as well as other methods described herein. One of skill in the art will also understood that substitutions of amino acids at functionally similar positions between different ion channels will result in a mutant ion channel capable of forming a transmembrane pore, alone or in the presence of one of more ion channel proteins. Accordingly, reference to a specific amino acid position in a human VGP will also refer to the amino acid occupying the same position in a related VGP sequence from another species. Because one of skill in the art will be capable of performing multiple sequence alignment using readily available tools, the skilled artisan will be capable of aligning the amino acid residues of the VGPs shown in FIG. 15 against VGPs, VGICs or VSPs from non-human species, including VGPs from insects and worms. For example, unless specifically indicated otherwise, it will be understood that the threonine residue at position 286 of the human Kv1.1 polypeptide sequence is functionally related to the methionine residue at position 356 of the *Drosophila* Shaker polypeptide sequence. One of skill in the art will also appreciate that because splice variants of RNA transcripts encoding VGICs are know in the art, reference to a specific amino acid position in a VGIC will also refer to the amino acid occupying the same position in a VGIC encoded by a splice variant RNA or that which corresponds to a splice variant isoform of a VGIC. One of skill in the art will also appreciate that VGICs from other species can be used in connection with the methods described herein. Accordingly, one of skill in the art will readily be capable of introducing amino acid substitutions in non-human VGICs by aligning the sequence of the non-human VGIC with the sequences of the VGICs described herein.

As used herein, the activity of a VGP can refer to the activity of a VGIC or the activity of any other protein that is regulated by voltage, for example a VSP. One of skill in the art will appreciate that the activity of a VGP can also be modulated by compounds that bind irreversibly or reversibly to the VGP, or compounds that bind irreversibly or reversibly to another protein or molecule that regulates the activity of the VGP. Where a compound regulates the activity of a VGP, one of skill in the art will readily be capable of determining the amount of the compound required to modulate (e.g. increase or decrease) the activity of the VGP, for example by determining the IC50 of the compound as it relates to its ability to modulate the activity of the VGP.

Where the VGP is a VSP, reference to the activity of the VSP can refer to the rate or ability of the VSP to dephosphorylate a target. For example, Ci-VSP dephosphorylates phosphatidylinositol 3,4,5-bisphosphate (PIP3) to phosphatidylinositol 4,5-bisphosphate (PIP2) upon membrane hyperpolarization. The methods described herein can comprise a step of introducing one or more mutations in a VSP that cause the VSP to exhibit altered voltage sensitivity. In certain embodiments, the mutation(s) causing the VSP to exhibit altered voltage sensitivity can be a mutation in one or more VSD(s) of the VSP. In certain embodiments, the mutation(s) can be in VSD transmembrane helices. In certain embodiments, the mutation(s) in the VSD transmembrane helices are mutations of amino acids facing the center of the VSD. In certain embodiments, the mutations can be located on VSD helix S4. In certain embodiments, the mutations are to one or more conserved arginine or lysine residues in helix S4. In certain other embodiments, the mutations are to one or more conserved aspartate or glutamate residues located elsewhere in the VSD. The mutated VSD will exhibit, by virtue of these mutations, abnormal voltage sensitivity of the VSD; by contrast, the non-mutated ("wild type") VSD exhibits no such altered voltage sensitivity. In certain aspects, the methods described herein relate to screening assays suitable for monitoring altered voltage sensitivity of a mutated VSP.

Where the VGP is a VGIC, reference to the activity of the VSP can refer to the rate or absolute amount of ion permeation through an ion channel. In certain embodiments, the permeation can be a measure of ion permeation through the alpha pore of the channel. In certain embodiments, VGIC activity as measured as a function of ion permeation, can be a measure of ion permeation that occurs independently from alpha pore permeation, for example permeation through an omega leak or a sigma leak. In certain embodiments, the activity of a VGIC can refer to the selectivity of an ion channel. For example, in certain embodiments, the methods described herein can be useful of determining whether a compound alters permeability of a channel for one ion as compared to another ion (e.g. calcium or potassium). A modulation of the activity of a VGIC can be reflected in a change in the VGIC activity as a function of voltage. For example, in certain embodiments, the activity of a VGIC will refer to the voltage of half-maximal ion permeation. In other embodiments, the activity of a VGIC can refer to the sensitivity of voltage dependent permeation. Methods for measuring the sensitivity of ion permeation are known in the art, and include, for example determining current-voltage (I-V) and conductance-voltage (G-V) curves, and/or including fits to the Boltzmann equation. The activity a VGIC can also refer to regulation of ion permeation through the VGIC that occurs as a result of post-translational modifications, for example by protein phosphorylation. In certain embodiments, the methods of the invention are useful for distinguishing between VGIC binding molecules that (a) that bind preferentially to a VGIC when the VGIC is in an open or activated functional state, (b) that bind preferentially to a VGIC in a closed or inactivated functional state, or (c) that bind non-preferentially to a VGIC in either a closed or inactivated, or open or activated, functional state. "Open" or "activated" both refer to a functional state of the VGIC that is competent to conduct ions, whereas "closed" or "inactivated" both refer to functional states of the VGIC that is not competent to conduct ions. For those VGICs that are not ion channels, the terms "open" and "closed" lose meaning; accordingly, for these proteins "activated" and inactivated" refer to functional states of the VGIC that are competent, or not, with respect to a particular functional property of the protein (e.g., an enzymatic activity), respectively. The methods described herein are suitable for identifying any number of compounds that bind VGICs, including, but not limited to small molecules, peptides, proteins, and antibodies, or derivatives and fragments thereof.

Voltage-Gated Protein Activity

Changes in the conformational configuration of VGPs occur in response to changes in membrane voltage. Voltage sensitivity of VGPs is provided by voltage sensor domain comprising S1, S2, S3 and S4 segments of VGPs. The voltage sensing function of the voltage sensor domain depends primarily on the presence of positively charged lysine or arginine residues (i.e. gating charges) within a transmembrane helical segment called the S4 segment. The S4 segment of VGPs typically contains between 4 to 8 gating charges capable of moving in response to changes in membrane potential. Movement of these positively charged residues in the S4 segment in the electric field of the membrane results in changes to the position of S6 segments and thereby triggers graded conformational changes of the VGP between closed (e.g., inactivated) and open (e.g. activated) states upon changes in membrane potential. Many VGPs exhibit significant voltage dependence upon changes in membrane potential wherein activity increases 10-fold for every 7 to 12 mV of changes in membrane potential.

In certain embodiments, determining VGP activity according to the methods described herein can comprise a step of stimulating a membrane comprising a VGP. Examples of stimuli suitable for use with the methods described herein include, but are not limited to, electrical stimulation, magnetic stimulation, chemical stimulation, biological stimulation, or combinations thereof. Where chemical stimulation is used, introduction of the stimulus can comprise contacting an ion channel comprised in a membrane with a salt (e.g. a sodium salt or a potassium salt). Chemical stimulation can also comprise contacting a membrane comprising a VGP with any pore forming molecule known in the art. Where biological stimulation is used, the stimulus can comprise a step of contacting a membrane comprising a VGP with a chemical or biological compound that modifies the activity of the VGP. Where magnetic stimulation is used, the stimulus can comprise exposing an ion channel comprised in a membrane to an alternating magnetic field. Where electrical stimulation is used, the introduction of the stimulus can comprise the use of a patch clamp and the application of an external electric field to an ion channel comprising a membrane.

One of skill in the art will readily be capable of determining the type, amplitude, intensity, concentration or frequency of a stimulus suitable for use with the methods described herein. For example, in the case of electrical stimulation, the voltage amplitude and the duration of stimulation can be selected on the basis of the activation kinetics of the VGP being examined. For example, in certain embodiments, an ion channel comprised in a membrane can be maintained at a first membrane potential prior to being subjected to a depolarizing pulse. The membrane comprising the VGP can then be returned to the first membrane potential. In certain embodiments, the membrane comprising the VGP can be subjected to a second membrane potential. In one embodiment, the second membrane potential will be more positive that the first membrane potential. In another embodiment, the first membrane potential will be more positive that the second membrane potential. Specific examples of first membrane potential voltages and second membrane potential voltages can be independently selected from about −300 mV, about −280 mV, about −260 mV, about −240 mV, about −220 mV, about −200 mV, about −180 mV, about −160 mV, about −140 mV, about −120 mV, about −100 mV, about −80 mV, about −60 mV, about −40 mV, about −20 mV, about 0 mV, about 20 mV, about 40 mV, about 60 mV, about 80 mV, about 100 mV, about 120 mV, about 140 mV, about 160 mV, about 180 mV, about 200 mV, about 220 mV, about 240 mV, about 260 mV, about 280 mV, about 300 mV, and ranges between any two of these values.

In certain embodiments, the VGP monitoring methods described herein can comprise a step of exposing the membrane comprising the VGP to at least one step voltage prior to subjecting them to the depolarizing pulse at a second membrane potential voltage. A step voltage can be a voltage that is between the voltage of the first membrane potential and the second membrane potential. For VGICs, in certain embodiments of the methods described herein, the step voltage can be used to measure non-specific leak currents that need to be subtracted to obtain the specific leak current of interest. For example, a monitoring method described herein can comprise a first membrane potential voltage of about −70 mV, a step voltage of about −40 mV, and a second membrane potential voltage of about 20 mV.

In embodiments where a depolarizing pulse is used in connection with the methods described herein, the depolarizing pulse can be applied for any length of time suitable for monitoring the activity of an ion channel. Suitable depolarizing pulse time lengths include about 10 microseconds, about 1 milliseconds, about 10 milliseconds, about 100 milliseconds, about 1 second, about 2 seconds, about 3 seconds, about 4 seconds, about 5 seconds, about 10 seconds, about 20 seconds, about 30 seconds, about 40 seconds, about 50 seconds, about 60 seconds, about 70 seconds, about 80 seconds, about 90 seconds, about 100 seconds, about 500 seconds, about 1000 seconds, about 2000 seconds, about 3000 seconds, about 4000 seconds, about 5000 seconds, and ranges between any two of these values.

Membrane depolarization can also be performed by altering ion concentrations. For example, in certain embodiments of the methods described herein, membrane depolarization can be performed by the addition of positive ions (e.g. K+ ions) into a medium comprising a VGP in a membrane (e.g. into a solution comprising a cell expressing the VGP) to induce depolarization by shifting the equilibrium potential. In certain embodiments, the amount of a positive ion added to the medium can be an amount sufficient to shift the equilibrium potential to the positive direction by about 30 mV, about 35 mV, about 40 mV, about 45 mV, about 50 mV, about 55 mV, about 60 mV, about 65 mV, about 70 mV, about 75 mV, about 80 mV, or more than about 85 mV. One of skill in the art will appreciate that the amount of depolarization will depend on the amount of ion added and that a desired amount of depolarization can depend on the VGP selected for investigation in conjunction with the methods described herein.

Other methods for depolarizing a membrane (e.g. the membrane of a cell) are also suitable for use with the methods described herein. For example, in certain embodiments, membrane depolarization can be performed with the use of potassium channel blockers, ion channel modulating agents. Examples of potassium channel blockers suitable for use with the methods described herein include, but are not limited to $Cs^+$, $Ba^{2+}$, and tetraethylammonium (TEA). Examples of small organic molecules suitable for use with the methods described herein include, but are not limited to, 4-aminopyridine, quinidine or phencyclidine. Examples of toxins suitable for use with the methods described herein include, but are not limited to, charybdotoxin, margatoxin, iberiotoxin, noxiustoxin, kaliotoxin.

Measuring Currents of VGICs

In certain aspects, the methods described herein relate to the use of ion channels that exhibit independent ion permeation. As used herein, the term "independent ion permeation" includes omega pore leak currents (i.e., omega pore dependent ion permeation) and sigma pore leak currents (e.g. sigma pore dependent ion permeation). Independent ion permeation (e.g., ion permeation that occurs elsewhere from the alpha pore) refers to ion permeation that occurs at a resting state potential as well as ion permeation that occurs at a non-resting state potential. Independent ion permeation also refers to ion permeation that occurs under polarized conditions and non-polarized conditions. As used herein, the term "polarized" refers to the existence of a voltage difference across a structure (e.g., a lipid bilayer, a membrane or a supporting layer) comprising a VGIC, a VGIC variant, or a fragment of a VGIC or a VGIC variant. In certain embodiments, the voltage difference across a structure can arise from a difference in the amount or concentration of charged species at one side of the structure relative to the other side of the structure. In certain embodiments, the voltage difference across a structure can arise from an applied voltage. In certain embodiments, the voltage difference across a structure can arise from a difference in the amount or concentration of charged species at one side of the structure relative to the other side of the structure in combination with an applied voltage.

The methods described herein can be performed by modifying an ion channel to induce the channel to exhibit non-alpha-pore ion conduction when the channel is in any of an open, closed, activated, or inactivated state. In certain respects, the methods described herein can be applied by introducing one or more mutations in a VGIC analogous to known mutations that cause VGICs to exhibit alpha-pore-independent ion conduction. The compounds identified by the methods described herein will be useful for the treatment of voltage-gated ion channel related channelopathies and other pathological or physiological conditions related to abnormal voltage-gated protein function.

VGICs that exhibit alpha-pore-independent ion conduction can be screened according to any method known in the art. For example, in certain embodiments, a VGIC that exhibits alpha-pore-independent ion conduction can be screened by expressing the VGIC in a cell and testing the activity of the VGIC both in the presence and absence of a test compound. Alternatively, the VGICs described herein can also be tested by expressing the VGIC in a cell prior to isolating the expressed VGIC and inserting the VGIC in an artificial membrane (e.g. a liposome) wherein the extracellular portion of the VGIC is on the first side of the membrane, and the intracellular portion of the VGIC on the second side of the membrane such that the VGIC forms a pore between a first side of the membrane and the second side of the membrane. In certain embodiments, the membrane can be impermeable to a test compound.

VGIC activity is reflected as a change in, for example, ion conductivity or catalytic activity, which depends upon changes in the potential across a membrane (e.g. a cell membrane). Membrane potential is the voltage difference between the inside and the outside of a membrane. Methods of measuring ion conduction or catalytic activity in accordance with the methods described herein can be by any method known in the art. Activity of a VGIC can be measured directly or indirectly. Direct methods include, but are not limited to, measuring, for a VGIC, a change in the concentration of one or more types of ions at one or both sides of a membrane; direct electrical measurement of the ionic current flowing across the membrane, or product formation or substrate consumption for catalytic activity of a VGIC. Indirect measurements can comprise measuring changes in membrane potential or changes in pH. Also suitable for use with the methods described herein is the use of functional metrics to measure the downstream effects of VGIC function. For example, when the VGICs described herein are expressed in an intact cell, cell specific effects can be determined as indicator of ion conduction through the VGIC. Examples of downstream effects of VGIC function include, but are not limited to, transmitter release (e.g., dopamine), hormone release (e.g., insulin), transcriptional changes to genetic markers (e.g., northern blots), cell volume changes (e.g., in red blood cells), immunoresponses (e.g., T cell activation), changes in cell metabolism such as cell growth or pH changes, and changes in intracellular second messengers such as [Ca2+].

In certain embodiments, the methods described herein involve a step of measuring membrane potential with patch clamp techniques (e.g. using a microelectrode, which is a saline-filled glass micropipette that impales a membrane comprising a VGIC) or through the use of voltage sensitive optical probes. Examples of optical probes suitable for use with the methods described herein include, but are not limited to those described in Gonzalez and Tsien, 1997.

The ability of a test compound to alter the permeations of a VGIC described herein can be determined by assessing a change in electrical potential of a cell or a membrane comprising the VGICs described herein. In certain embodiments, the changes in cellular polarization in the presence or absence of a test compound can be performed by measuring whether there is a change in current through a VGIC when the VGIC is contact with a test compound. The concentration of the test compounds used in conjunction with the methods described herein can be any concentration that affects alpha-pore-independent ion conduction of the VGICs described herein. In certain embodiments, the concentration of a test compound is in the range of 1 pM to 100 mM.

Any method known in the art for measuring the activity of a VGIC can be used in connection with the methods described herein and include but are not limited to those described in Gonzalez et al., Drug Discov Today. 1999 September; 4(9):431-439. Exemplary methods include, but are not limited to techniques that employ patch clamp measurement, fluorescence measurement, absorbance measurement, radio labeled measurement, and biological assay measurement (e.g., Ca2+ release, hormone, pH, etc.).

In certain embodiments, the methods described herein can include measuring conductance through a VGIC using a patch clamp technique. In patch clamp techniques, a voltage clamp can be used to control the membrane potential across a membrane. The circuit resistance in a patch clamp measurement technique can depend on the characteristics of the assay system. For example, resistance in an oocyte system can be different than resistance in a cell line system. The aperture of the pipette used in a patch clamp procedure can be any suitable size (e.g. about 1 μm), however, one of skill in the art will readily be capable for determining an appropriate membrane patch size for a particular assay condition. Generally, the patch clamp procedure involves placement of the polished aperture of a glass pipette against a membrane comprising the test VGIC. The application of suction results in the formation of a resistant seal between the membrane and the pipette. The current measured in a patch clamp technique will be the current passing through the VGICs and the leak currents escaping between the pipette and the membrane, through the membrane, and through other ion channels. One of skill in the art will readily be capable of determining the appropriate degree of sealing required between the pipette and the membrane suitable for obtaining patch clamp recordings.

Several different patch clamp methodologies are known in the art and are suitable for use with the methods described herein. Such patch clamp methods include, but are not limited to whole cell perforated patch clamp methods, cell attached patch clamp methods, conventional whole cell methods, and excised (inside out) patch clamp methods. Also suitable for use with the methods described herein are planar patch clamp methods. For planar patch clamping, a membrane (e.g. a cell membrane) comprising a VGIC is attached by suction to an aperture in a planar substrate. This step eliminates the need for manual manipulation of a glass pipette as otherwise required for certain traditional patch clamp techniques. Patch clamp methods can be used to record ion channel activity in sub-millisecond time scales. In addition to the study of populations of ion channels expressed in a cell, methods are known in the art to adapt patch clamp methods for studying the activity of single ion channels.

The methods described herein can be performed by using any patch clamp method known in the art that is suitable for analyzing ion channel function (Neher, E. and Sakmann, B., Nature 260(5554): 799-802 (1976); Hamill, O. P., et al., Pflugers Arch. 391(2): 85-100 (1981)). In certain embodiments, patch clamp analysis can be performed by contacting a cell expressing a VGIC with the tip of a glass micropipette to obtain a leakage resistant seal (>1 GOhm, GigaSeal). Generally, in the whole-cell configuration of the patch clamp method, the intra-pipette portion of the membrane makes direct electrical contact between the cell interior and the pipette electrode. The method allows the application of different voltages to the pipette electrode whereby the measured currents represent the current through the cell membrane. This current through the cell membrane include current passing through ion channels expressed in cellular membranes. In one embodiment, the methods described herein can comprise a step of monitoring the activity of an ion channel using the two electrode voltage clamp technique. In the two electrode voltage clamp technique, two electrodes are used wherein one electrode is dedicated to the passing current whereas a second electrode is dedicated to voltage recording. Where two electrodes are used to monitor ion channel activity, it can be desirable to express an ion channel selected for monitoring in a cell that is of sufficient size to facilitate the use of two electrodes. Accordingly, because oocytes of the African clawed toad (*Xenopus laevis*) are large in size, the two electrode method can be performed on *Xenopus* oocytes that have been microinjected with cDNA or cRNA encoding an ion channel selected for monitoring. Other patch clamp methods suitable for use with the methods described herein are also known, and include, but are not limited to the "cell-attached" patch clamp technique, the "inside-out" patch clamp technique, and the "whole cell" patch clamp technique (see, e.g., Ackerman et al., New Engl. J. Med. 336:1575-1595 (1997); Hamil et al., Pflugers. Archiv. 391:85 (1981)).

In certain embodiments, florescent probes and dyes can be used to detect the intracellular or subcellular concentrations of ions. One of skill in the art will appreciate that several different dyes are available with different affinity ranges and applications.

Voltage sensitive dyes responsive to changes in membrane potential can be used to measure absolute membrane potentials as well as to measure changes in membrane potential in accordance with the methods described herein. Such changes in membrane potential can be use as a non-linear readout of a change in ion channel activity. The responsiveness of voltage sensitive dyes to changes in membrane potential occur as a result of changes in the distribution of the intramolecular charges, which then results in a change in their fluorescent emission intensity and spectral patterns. In certain embodiments, the dye used to measure membrane potential can be the fluorescent dye bis-(1,3-dibutylbarbituric acid) trimethine oxonol.

Any voltage sensitive dye suitable for detecting a change in membrane potential can be used in conjunction with the methods described herein, including, but not limited to, coumarin dyes, anionic and hybrid oxonol dyes, hemicyanine dyes, merocyanine dyes, cationic or zwitterionic styryl dyes, and cationic carbocyanines and rhodamines. Examples of coumarin dyes suitable for use with the methods described herein include, but are not limited to, N-(6-chloro-7-hydroxycoumarin-3-carbonyl)-dimyristoylphosphatidyl-ethanol-amine (CC2-DMPE). Examples of anionic and hybrid oxonol dyes suitable for use with the methods described herein include, but are not limited to, bis-oxonol, oxonol V (bis-(3-phenyl-5-oxoisoxazol-4-yl)pentamethine oxonol), oxonol VI (bis-(3-propyl-5-oxoisoxazol-4-yl)pentamethine oxonol), bis-(1,3-diethylthiobarbituric acid)trimethine oxonol (DiSBAC$_2$(3), bis-(1,3-dibutylbarbituric acid)trimethine oxonol (DiBAC$_4$(3), bis-(1,3-dibutyl-barbituric acid)pentamethine oxonol (DiBAC$_4$(5), RH-155 (NK3041), RH-479 (JPW1131), RH-482 (JPW1132, NK3630), RH-1691, RH-1692, RH-1838, RH-1114 (WW781), JPW1177, and JPW1245. Examples of hemicyanine dyes suitable for use with the methods described herein include, but are not limited to, dibutylamino-naphthalene-butylsulfonato-isoquinolinium (BN-BIQ). Examples of merocyanine dyes suitable for use with the methods described herein include, but are not limited to, merocyanine 540, NK2495 (WW375), and JPW1124. Examples of cationic or zwitterionic styryl dyes suitable for use with the methods described herein include, but are not limited to, di-4-butyl-amino-naphthyl-ethylene-pyridinium-propyl-sulfonate (di-4-ANEPPS), di-8-butyl-amino-naphthyl-ethylene-pyridinium-propyl-sulfonate (di-8-ANEPPS), di-12-ANEPPS, di-18:2-ANEPPS, di-2-ANEPEQ (JPW1114), di-12-ANEPEQ, di-8-ANEPPQ, di-12-ANEPPQ, di-1-ANEPIA, D-6923 (JPW3028), N-(4-sulfobutyl)-4-(6-(4-(dibutylamino)phenyl)hexatrienyl) pyridinium (RH-237), N-(3-triethylammoniumpropyl)-4-(4-(4-(diethylamino)phenyl)butadienyl)pyridinium dibromide (RH-414), N-(4-sulfobutyl)-4-(4-(4-(dipentylamino)phenyl) butadienyl) pyridinium (RH-421), RH-437, RH-461, RH-795, JPW1063, and FM1-43. Examples of cationic carbocyanines and rhodamines suitable for use with the methods described herein include, but are not limited to, 3,3'-diethyloxacarbocyanine iodide (DiOC$_2$(3)), 3,3'-dihexyloxacarbocyanine iodide (DiOC$_6$(3)), 3,3'-dimethyl-naphthoxacarbocyanine iodide (JC-9; DiNOCl(3)), 3,3'-dipentyloxacarbocyanine iodide (DiOC.sub.6(3)), 3,3'-dipropylthiadicarbocyanine iodide (DiSC.sub.3(5)), 1,1',3,3,3',3'-hexamethylindodicarbocyanine iodide (DilC.sub.1(5)), rhodamine, rhodamine 123, 5,5',6,6'-tetrachloro-1,1',3,3'-tetraethylbenzimidazolylcarbocyanine iodide (CBIC.sub.2(3)), tetramethylrhodamine, ethyl ester, perchlorate (TMRE), and tetramethylrhodamine, methyl ester, perchlorate (TMRM). Other voltage sensitive dyes suitable for use with the methods described herein include those described in Grinvald et al., 68(4) Physiol. Rev. 1285-1366 (1988); Lowe and Goldfinch, 137 Methods Enzymol. 338-348 (1988); Katerinopoulos, 10(30) Curr. Pharm. Des. 3835-3852 (2004); Johnson, Fluorescent Probes for Living Cells 30(3) Histochem. J. 123-140 (1998); IMAGING NEURONS: A LABORATORY MANUAL (Rafael Yuste, et al., eds., Cold Spring Harbor Laboratory Press, 2000).

In certain embodiments, the methods described herein are performed using fast response dyes, slow response dyes, or a combination of both fast and slow response dyes. Fast response dyes are dyes that undergo rapid intramolecular charge distribution upon electrical field changes which alter the spectral properties and/or the fluorescence intensity of the dye. In general, fast response dyes can be used to detect millisecond time scale changes in membrane potential. In certain embodiments, fast response dyes can be used in connection with the methods described herein where the method comprises monitoring the conductance of a VGIC in an excitable cell, such as a neuron or a cardiac cell. Examples of fast response dyes suitable for use with the methods described herein include, but are not limited to, di-2-ANEPEQ (JPW1114), di-1-ANEPIA, di-8-ANEPPQ, di-12-ANEPPQ, di-4-ANEPPS, di-8-ANEPPS, di-18:2-ANEPPS, RGA-30, RH-155, RH-795, RH-237, RH-421, RH-414, and WW 781. Slow response dyes are generally lipophilic anions or cations that can be used to detect changes in membrane potential as a function of their transmembrane distribution. For example, DiBAC dyes have a slower response time as compared to di-ANEPPS dyes because they generally need to traverse a lipid membrane and bind to an intracellular component in order to produce a fluorescent signal. In certain embodiments, slow response dyes can be used in connection with the methods described herein where the method comprises monitoring the conductance of a VGIC in a non-excitable cell as a result of respiratory activity, ion-channel permeability, drug binding, or other factors. Examples of slow response dyes suitable for use with the methods described herein include, but are not limited to, DiSBAC.sub.4(3), DiBAC.sub.4(5), DiBAC.sub.4(3), DiOC.sub.5(3), DiOC.sub.6(3), DiSC.sub.3(5), DiOC.sub.2(3), DiNOC.sub.6(3), DilC.sub.2(5), merocyanine 540, Oxonol V, Oxonol VI, rhodamine 123, TMRM, TMRE, and CBIC.sub.2(3).

In certain embodiments, the methods described herein can be used in conjunction with calcium sensitive dyes. For example, using fluorescent probes such as Fluo-3 and Calcium Green can be used to monitor cellular, and subcellular, calcium concentrations as a function of ion channel activity. In general, free calcium concentration in a cell is about 100 nM, however one of skill in the art will readily be capable of measuring the concentration of free calcium in a cell.

Ion channel activity can also be monitored by measuring the transport of ions across a membrane. For example, in the case of many potassium channels, rubidium ions can be used as a tracer and fluorescent dyes that are sensitive to rubidium can be used to determine membrane permeability to rubidium (Terstappen, 1999; Vestergarrd-Bogind et al., J Membrane Biol. 88:67-75 (1988); Daniel et al., J. Pharmacol. Meth. 25: 185-193 (1991): Holevinsky et al. J. Membrane Biology 137:59-70 (1994)).

Ion channel activity can also be monitored by measuring the transport of ions across a membrane. For example, in the case of many potassium channels, thallium ions ($Tl^+$) can be used as a tracer and fluorescent dyes that are sensitive to thallium can be used to determine membrane permeability to thallium (e.g., Weaver et al. (2004) "A Thallium-Sensitive, Fluorescence-Based Assay for Detecting and Characterizing Potassium Channel Modulators in Mammalian Cells" Journal of Biomolecular Screening 9(8):671-677; Wang et al. (2011) Selective inhibition of the K(ir)2 family of inward rectifier potassium channels by a small molecule probe: the discovery, SAR, and pharmacological characterization of ML133. ACS Chem. Biol. 6(8):845-856).

Also suitable for use with the methods described herein are voltage-sensing Fluorescence Resonance Energy Transfer (FRET) acceptors (Gonzalez and Tsien, 4(4) Chem. Biol. 269-277 (1997); U.S. Pat. Nos. 5,661,035; 6,107,066). FRET can be used to measure changes in membrane potential in accordance with the methods described herein by determining the amount of energy transfer and quenching of fluorescence intensity between a donor fluorophore and an acceptor fluorophore. In certain embodiments, membrane depolarization can be detected as a function of a change in donor fluorescence, acceptor fluorescence, or in the emission maxima of a donor fluorophore and/or acceptor fluorophore. Examples of donor fluorophore and acceptor fluorophore pairs suitable for use with the methods described herein include, but are not limited to, CC2-DMPE and $DiSBAC^2(3)$; CC2-DMPE and $DiSBAC^4(3)$; CC2-DMPE and RH-155 (NK3041); CC2-DMPE and RH-479 (JPW1131); CC2-DMPE and RH-482 (JPW1132, NK3630); CC2-DMPE and RH-1691; CC2-DMPE and RH-1692; CC2-DMPE and RH-1838; CC2-DMPE and R-1114 (WW781); CC2-DMPE and JPW1177; and CC2-DMPE and JPW1245.

Suitable voltage-sensing FRET acceptors include, but are not limited to, coumarin-tagged phospholipids integrated into the cell membrane. For example, coumarin-phospholipid CC2-DMPE partitions to the extracellular half of the plasma membrane and is excited by 405 nm light and can be used in connection with the methods described herein.

In embodiments where florescence or light emission is detected as a measure of ion channel conductance (e.g. where voltage-sensitive dyes are used), the emission of fluorescence or light can be detected by any suitable method known in the art. For example, in certain embodiments, the emission of fluorescence or light can be detected with the use of a fluorimeter.

In certain embodiments, fluorescence or light emission based methods for measuring ion channel function can be performed using high-throughput formats including, without limitation, 96-well, 384-well or 1536-well plates. Instruments useful for high-throughput measurement of fluorescence or light emission include, but are not limited to Fluorometric Imaging Plate Reader or a Voltage/Ion Probe Reader (U.S. Pat. No. 6,342,379; Gonzalez and Maher, 8(5-6) Receptors Channels 283-295, (2002); U.S. Pat. No. 6,686,193).

Where fluorescence or light emission is used as a measure of ion channel conductance, a change in ion channel function can be detected as a change (e.g. an increase or decrease) in fluorescence or light emission relative to a control sample. In certain embodiments, the change will be greater than about a 5% change in fluorescence or light emission, greater than about a 10% change in fluorescence or light emission, greater than about a 20% change in fluorescence or light emission, greater than about a 30% change in fluorescence or light emission, greater than about a 40% change in fluorescence or light emission, greater than about a 50% change in fluorescence or light emission, greater than about a 60% change in fluorescence or light emission, greater than about a 70% change in fluorescence or light emission, greater than about a 80% change in fluorescence or light emission, greater than about a 90% change in fluorescence or light emission, or greater than about a 100% change in fluorescence or light emission.

In certain embodiments, the methods described herein can include measuring conductance through a VGIC using a radiolabel measurement technique. Many radiolabelling methods are known in the art. For example, $^{86}$Rb+ can be used as a flux tracer because it can permeate through VGPC as well as other channels having similar properties, however radioactive tracers for Na+, Ca2+ and Cl− also are available (see generally, Terstappen G C. (2004) Assay Drug Dev. Technol. 2: 553-559). Generally, the radioactive tracer is incubated with the ion channel (either in a cell or on a support, such as a membrane) and the excess tracer is then removed to determine channel activity. In certain embodiments, the channels can be retained in an open or a closed conformation and additional compounds or agents can be contacted with the channel to determine whether the compound or the agent modifies permeation of the radioactive tracer through the channel. One of skill in the art will readily be capable of measuring either influx or efflux using radioactive tracers.

In certain embodiments, the methods described herein can include measuring VGIC activity with a biological assay. For example, the activity of the VGICs described herein can be measured, as non-limiting examples, by the ability to be regulated by ligands, including known neurotransmitters, agonists and antagonists, including but not limited to serotonin, acetylcholine, nicotine, and GABA. Alternatively, the activity of the ion channel can be assayed by examining their ability to modulate intracellular Ca2+ concentration, a mitogenesis assay, a MAP Kinase activity assay, an arachidonic acid release assay (e.g., using [3H]-arachidonic acid), induce gene transcription or expression, modulate extracellular acidification rates, as well as other binding or function-based assays of activity that are generally known in the art.

Voltage-Gated Ion Channel Families

Voltage-Gated Sodium Channels (VGSCs) are expressed in membranes of excitable cells and function in the depolarization phase of action potentials. VGSCs expressed in mammalian brain tissues comprise pore forming and voltage sensing elements within a single polypeptide chain. There are nine known VGSC alpha subunits termed $Na_v1.1$ to $Na_v1.9$ which together make up a subfamily having about 70% amino acid sequence identity within their transmembrane segments (Goldin et al, 2000; Catterall et al. (2005) Pharmacol Rev 57:397-409).

Under resting conditions, the membrane potential of an excitable cell, as measured inside relative to outside, is polarized and can, in a non-limiting embodiment, be in the range of about −60 mV to about −80 mV. Thus, at normal resting potentials, VGSCs will be in a closed confirmation and be non-conducting. VGSCs generally adopt an open conformation upon membrane depolarization (about −40 mV) to allow a flow of sodium ions down a concentration gradient from the outside of the cell to the inside of the cell.

Voltage-Gated Calcium Channels (VGCCs) are similar to VGSCs and have an alpha subunit analogous to the alpha subunit of sodium channels (Catterall et al. (2005) Pharmacol Rev 57:411-425). As with VGSCs, the alpha subunit of VGCCs is sufficient to form an ion selective pore by itself. There are been at least three VGCC alpha subunit subfamilies described in vertebrates. The $Ca_v1$ subfamily ($Ca_v1.1$ to $Ca_v1.4$) conducts L-type (long-lasting) currents (Hoffmann at al, 1994; Streissnig, 1999). Agents which block calcium channels are known in the art. For example, phenylalkalamines, dihydropyridines, and benzothiazepines bind to S5 and S6 segments in domain III and the S6 segment in domain IV and block the function of $Ca_v1.2$ channels. The $Ca_v2$ subfamily ($Ca_v2.1$ to $Ca_v2.3$) conduct N-, P/Q, and R-type calcium currents. It is known that $Ca_v2$ subfamily members can be blocked with spider and cone snail venoms (Smith and Reiner, 1992, Dunlap et al, 1995; Catterall, 2000b; Olivera et al, 1994). The $Ca_v3$ subfamily ($Ca_v3.1$ to $Ca_v3.3$) conduct T-type (transient) calcium currents (Perez-Reyes, 2003).

Voltage-Gated Potassium Channels (VGPCs) undergo activation in response to membrane depolarization to promote outward movement of potassium ions to allow the termination of action potentials through membrane repolarization. At least 40 different VGPC alpha subunits have been identified across 12 different VGPC subfamilies (Kv1 to Kv12) (Gutman et al, 2003; Gutman et al. (2005) Pharmacol Rev 57:473-508). The first VGPC characterized was cloned in *Drosophila* on the basis of a "Shaker" phenotype (Jan and Jan, 1997). Several types of potassium channels are known in the art. These include potassium channels in cardiac muscle, including but not limited to inward rectifying K+ channels (IKr), delayed rectifying K+ channels (Kv or IKs) and transient outward K+ channels (IKTo); many of these cardiac potassium channels belong to the VGPC family.

VGPCs comprise tetramers of alpha subunits wherein each alpha subunit comprises six hydrophobic transmembrane segments (S1 to S6) and wherein the alpha subunits are assemble around the central pore. Both VGSCs and VGCCs share sequence identity and structural similarity to Shaker potassium channel members, however, as mentioned above, VGPCs are formed by homomeric or heteromeric alpha subunit tetramers, whereas in the case of VGCCs and VGPCs, the channel pore is formed by a single alpha subunit comprising four sequential pseudo-domains (each of which is homologous to a VGPC alpha subunit). The central ion conductive pore (the alpha pore) of VGPCs is formed in alpha subunit tetramers by the region comprising the S5 and S6 segments of each alpha subunit within the channel complex. Ion selectively of VGICs depends on a hydrophobic 20 amino acid loop, the so-called "P-loop," located between the S5 and S6 segments. This ion selectivity loop is conserved between VGPC subfamilies and is marked by a [T/S]-[M/L/Q]-T-T-[I/V]-G-Y-G signature sequence (SEQ ID NO: 200). This S5-loop-S6 domain is termed the Pore Domain (PD).

Voltage-Gated Proton Channels (VGHCs) are expressed in the membranes of many cell types and appear to facilitate diverse physiological functions. For example, the human VGHC Hv1 is known to regulate reactive oxygen species production by leukocytes, histamine secretion by basophils, sperm capacitation, and airway pH. (Ramsey et al. (2006) A voltage-gated proton-selective channel lacking the pore domain. Nature 440:1213-1216).

Additional voltage-gated ion channels, all of which possess VSDs structurally and functionally analogous to those discussed above, comprise the HCN and CatSper ion channel families, and certain members of the KCa ion channel family.

The HCN channel family comprises HCN1, HCN2, HCN3, and HCN4 (Hofmann et al. (2005) "International Union of Pharmacology. LI. Nomenclature and Structure-Function Relationships of Cyclic Nucleotide-Regulated Channels" *Pharmacol Rev* 57:455-462). HCN channels are found in neurons and the heart; in the heart these channels control heart rate and rhythm by form the so-called "Ih" or "pacemaker current" in the sino-atrial node; in neurons these channels help to determine resting potentials, the transduction of sour taste, and synaptic transmission and plasticity. Drugs that interact with HCN channels, for example ivabradine and cilobradine, find use as heart rate-lowering agents in the therapy of angina pectoris.

The CatSper channel family comprises CatSper1, CatSper2, CatSper3, and CatSper4 (Clapham & Garbers (2005) "International Union of Pharmacology. L. Nomenclature and Structure-Function Relationships of CatSper and Two-Pore Channels" *Pharmacol Rev* 57:451-454). CatSper1 and CatSper2 control intracellular $Ca^{2+}$ levels in sperm cells; CatSper1- or CatSper2-null sperm cells cannot be hyperactivated, and these gene knockouts result in a male sterile phenotype. CatSper-interacting drugs may find use as fertility modulating agents.

The BK (also known as Slo1 or MaxiK) channel, a member of the KCa ion channel family, also contains VSDs which modulate the channel's ion conductance in response to membrane voltage (Wei et al. (2005) "International Union of Pharmacology. LII. Nomenclature and molecular relationships of calcium-activated potassium channels" *Pharmacol Rev* 57:463-472). The BK channel modulates diverse intracellular $Ca^{2+}$ signaling responses, and as such play diverse roles in normal physiology and pathophysiology. For example, it has been found that alterations in BK channel function can cause hypertension (Holtzclaw et al. (2011) "Role of BK channels in hypertension and potassium secretion" *Curr Opin Nephrol Hypertens* 20(5):512-517).

In VGSCs, VGCCs, and VGPCs, the ion permeability of the pore domain is controlled by the voltage sensor domains, which surround the central pore domain. Opening of the pore domain occurs in a process wherein transmembrane voltage changes induce four conserved positively charged residues (e.g. arginine residues) in the S4 segment of each VSD in each of the four alpha subunits (VGPCs), or the four pseudo-domains (VGSCs and VGCCs), to move outward across the membrane; complete outward movement all four S4 transmembrane segments in a channel subsequently induces the pore domain to open, allowing it to conduct ions (see Hille B. (2001) Ion Channels of Excitable Membranes, 3rd Ed., pp. 131-143; Tombola et al., 2006) Annu. Rev. Cell Dev. Biol. 22, 23-52). This opening process is also known as "gating". The ion current passing through the main pore is called the "alpha current".

The pore-forming alpha subunits of channels in three of the four VGIC families, the VGSCs, the VGCCs, and the VGPCs, are comprised of four subunits, or in some cases, four pseudo-domains that provide functional similarity to subunits. VGPCs comprise four subunits, arranged either as homotetramers or heterotetramers. VGSCs and VGCCs comprise a single polypeptide chain that contains within it four pseudo-domains; each of these pseudo-domains has high sequence homology in comparison to the other three pseudo-domains of that particular VGSC or VGCC, and in comparison to the pseudo-domains in other VGSCs or VGCCs, or the alpha subunits of VGPCs. The alpha subunits of VGPCs, or each pseudo-domain of the VGSCs and VGCCs alpha subunits, each comprise a conserved voltage sensing VSD (comprised of transmembrane S1, S2, S3, and S4 segments) followed in primary sequence by a conserved pore forming ion conduction pathway, the pore motif, wherein a narrow outer pore mouth comprises so-called "P-loops" between the transmembrane S5 and S6 segments. VGSCs, VGCCs, and VGPCs are each distinguished from one another by certain conserved sequences in these P-loops, which appear to confer selectivity for the transport of particular types of ions. VGICs can be classified by gating type and gating number.

In commonality with VGSC, VGCC, and VGPC alpha subunits, the voltage-sensing elements of VGHCs comprises a VSD, again comprised of conserved transmembrane 51, S2, S3, and S4 segments. In distinction to the VGSC, VGCC, and VGPC alpha subunits, VGHCs lack a pore motif. Instead, the VSD itself appears to constitute the pore forming ion conduction pathway within VGHCs. Additionally, VGHCs appear to function as dimers, not tetramers.

Gating in VGHCs occurs when transmembrane voltage changes induce four conserved positively charged residues (e.g. arginine residues) in the S4 segment of each VSD to outward across the membrane; it appears that both S4 segments in VGHC dimers need to move (at least partly) outward to allow one or both VGHC VSDs to attain a conformation that allows conduction of protons. Distinct from VGSCs, VGCCs, and VGPCs, however, VGHCs conduct protons directly through activated (or open) VSDs, rather than through a separate pore domain.

In the case of Shaker potassium channel members, the pore changes conformation to an inactivated state upon extended depolarization. N-type and C-type inactivation of Shaker potassium channel members is also known.

Ion Channel Current Leak Amino Acid Substitutions

VGICs having defined mutations have revealed the existence of another ion current, termed the omega leak current (i.e., omega pore dependent ion permeation). For example, substitution of arginine residues in the S4 helix of the Shaker channel with a smaller, typically polar, uncharged amino acid (e.g. serine or cysteine) results in an omega leak current through the voltage sensing domains of the Shaker channel that allows ion permeation independently of the normal alpha pore current (Tombola et al., Nature. 2007 Feb. 1; 445(7127):546-9). In the case of rat or human Kv1.2 these arginine residues are located at positions 294, 297, 300, and 303 of the protein. One of skill in the art will readily be capable of identifying positively charged residues in the voltage sensing domain of other VGICs or other VGPs on the basis of sequence identity between VGICs. One of skill in the art will also understand that certain classes of VGICs (e.g., VGCCs and VGSCs) can have four distinct VSDs, whereas other VGICs (e.g., VGPCs) have only one distinct VSD. A VGIC having an omega pore ion permeation can be a VGIC comprising an omega pore ion permeation inducing amino acid substitution at one or more positions in the VSD in a VGIC heterotetrameric complex (e.g. a mixed tetrameric VGIC complex) or in a VGIC that is not a heterotetrameric complex (e.g. a homotetrameric VGIC complex).

The omega leak current passes through an omega pore located in the voltage sensing domains (S1-S4) of the channel (Tombola et al., (2006) Annu. Rev. Cell Dev. Biol. 22, 23-52; Tombola et al., (2005) Neuron 45, 379-388; Tombola et al., (2007) Nature 445, 546-549; Sokolov et al., (2007) Nature 446, 76-78; Sokolov et al., (2005) Neuron 47, 183-189; Starace et al., (1997) Neuron. 19:1319-1327). Omega currents are nonselective and allow conduction of various cations. The omega leak current can be observed by investigation under hyperpolarizing conditions when the S4 segment and the alpha pore are in the closed configuration.

Omega leak currents can also be observed for VGICs having certain other defined VSD mutations; in this case, omega currents are observed under depolarizing conditions when the S4 segment and the alpha pore are in the open configuration (Sokolov et al., (2007) Nature 446, 76-78; Sokolov et al., (2005) Neuron 47, 183-189). Observation of these latter omega currents is facilitated by modulating experimental conditions (e.g., through use of ion channel modulating agents) so as to block the normal alpha current.

Another leak current, termed the "sigma current", has also been identified in the Shaker-related human Kv1.3 channel. The sigma pore pathway was identified by examining the conductance properties of a VGPC human Kv1.3 mutant protein having a V to C mutation corresponding to *Drosophila* Shaker position 438 (Pruning and Grissmer, J Biol Chem. 2011 Jun. 3; 286(22):20031-42). The sigma leak current appears to be functionally similar to the omega leak currents described above. The mutation that induces sigma currents appears to be physically distinct, however, from those mutations that induce omega currents; the sigma current mutation is located adjacent to the normal alpha pore, rather than being located within the VSD, as is the case for omega current-inducing mutations. A VGIC having a sigma pore ion permeation can be a VGIC comprising a sigma pore ion permeation inducing amino acid substitution at one or more positions adjacent to the normal alpha pore in a VGIC heterotetrameric complex or in a VGIC that is not a heterotetrameric complex (e.g. a homotetrameric VGIC complex). In certain embodiments, an alpha pore current or an omega pore current can be more amenable to reliable measurement than a sigma pore current.

Other abnormal currents can be observed in VGHCs, for example the human Hv1 channel, in the presence of certain VSD mutations, in particular mutation of aspartate residue 112 (Berger and Isacoff, (2011) Neuron, 27:991-1000; Musset et al., (2011), Nature, 480:273-277). These currents, which can be carried by various anions or cations depending on the experimental conditions, also appear to flow through the mutated VSD.

The methods described herein relate to the use of ion channels comprising one or more mutations, wherein the mutations cause the ion channel to exhibit ion permeability when the ion channel is in a closed conformation and/or when the ion channel is in an inactivated conformation. In certain embodiments, the channels having closed and/or inactivated configuration permeability can be channels having omega pore dependent ion permeation, or channels having sigma pore dependent ion permeation.

Several mutations causing omega or sigma pore dependent ion permeation have been identified in the art. For example, and without wishing to be bound by theory, in the case of the Kv2.1 ion channel, mutation of conserved gating residues (e.g. arginine or lysine) residues in the S4 helix of the protein can cause the multimeric forms of the protein to exhibit nonselective conductance of various cations in the form of an omega current, even when the Kv2.1 VGIC complex is in a closed or inactive conformation. Such mutations include, but are not limited to an R300Q, R303Q mutation, an R306Q mutation, or an R309Q mutation, or any combination thereof in human Kv2.1.

Because VGIC proteins exhibit sequence identity and structural similarity, one of skill in the will readily be capable of introducing analogous mutations in other VGIC proteins so as to cause the other VGICs to exhibit non-alpha pore dependent leaks. One of skill in the art will readily be capable of identifying the S4 helix, and the arginine residues therein, in other ion channels from different subfamilies, families and species using standard sequence comparison algorithms. One algorithm that can be used to identify gating residues in a ion channel suitable for mutation to introduce a omega current in the ion channel in the BLAST sequence alignment program, however, other programs suitable for use to align two or more sequences according to primary sequence and/or predicted or known secondary structural features of an ion channel can also be used. For example, an alignment between the human Kv2.1 protein and the human Kv2.2 protein shows that the S4 helix residues at positions R303, R306, and K309 of human Kv2.1 correspond to positions R307, R310 and K313 of the human Kv2.2 protein. Thus, one of skill in the art will readily appreciate that introduction of an R307Q mutation, an R310Q mutation or a K313Q mutation will cause human Kv2.2 to exhibit an omega leak current when it is in closed and/or inactivated state. Similar methods can be used to identify residues in other ion channel proteins to generate ion channels exhibiting an omega leak current in a closed and/or inactivated state. Additional positively charged S4 residues may need to be mutated, (e.g., R291 and R290 in $K_v2.1$) to enhance omega-pore dependent ion permeation.

Where the VGP is a VGIC, one or more mutations can be introduced into the VGIC to cause the VGIC to exhibit a leak current when the ion channel is in a closed conformation and/or when the ion channel is in an inactivated conformation. Alternatively, where the VGP is a VSP, one or more mutations can be introduced into the VGIC to cause the VGIC to exhibit altered voltage sensitivity.

In certain embodiments, the mutation is an R to S or R to N mutation at a position within the S4 helix of the VGIC. Without wishing to be bound by theory, in certain embodiments, analogous mutations can be introduced to generate variants of VGICs described herein wherein one or more arginine residues in the S4 helix of the VGIC are substituted with another amino acid having a non-polar side chain so as to mimic the effect of the R to S or R to N mutation in the mutated VGIC. Amino acid residues having similar side chain configurations have been defined in the art within in accordance with the following categories: basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine), aromatic side chains (e.g., tyrosine, phenylalanine, tryptophan, histidine), aliphatic side chains (e.g., glycine, alanine, valine, leucine, isoleucine), and sulfur-containing side chains (methionine, cysteine). Substitutions can also be made between acidic amino acids and their respective amides (e.g., asparagine and aspartic acid, or glutamine and glutamic acid).

Several mutations causing omega or sigma channel leaks have been identified in the art. For example, and without wishing to be bound by theory, in the case of the Kv2.1 ion channel, mutation of conserved or non-conserved gating residues (e.g. arginine or lysine residues) in the S4 helix of the protein can cause the multimeric forms of the protein to exhibit nonselective conductance of various cations in the form of an omega current, even when the Kv2.1 VGIC complex is in a closed or inactive conformation. Such mutations include, but are not limited to an R294N mutation or an R300S mutation, or any combination thereof in human Kv2.1. Thus, in one embodiment, an ion channel having an omega leak suitable for use with the methods described herein will be a Kv2.1 protein comprising an amino acid substitution at any of positions R300, R303, or R306, wherein the substitution replaces the positively charged arginine residues with an amino acid substituent residue having uncharged polar side chains wherein any of the arginine as positions R300, R303 or R306 are replaced with any of glycine, asparagine, glutamine, serine, threonine, tyrosine, cysteine or glutamic acid. One of skill in the art will readily be capable of identifying other variants of the mutated VGICs described herein. In one embodiment, the mutations in Kv2.1 include, but are not limited to an R294N mutation, an R300S mutation, an R294C mutation, an R293S mutation, an R294S mutation, or any combination thereof. For example, human Kv2.1 can have mutations R294C and R300S, mutations R293S and R294S, mutations R293S and R294C, mutations R293S, R294S, and R300S, or mutations R293S, R294C, and R300S. In one embodiment, a Kv2.1 protein can be mutated to remove extracellular cysteine residues. In some embodiments, the Kv2.1 protein with mutations R293S, R294S, and R300S can be used for drug screening.

Similarly, mutation of *Drosophila* Shaker R362 to histidine, for instance, is associated with abnormal omega currents; these currents are H$^+$ currents (Starace et al., *Nature* 427, 548-553 (2004)). Additional mutations of Shaker R362 which give rise to omega currents, carried by, e.g., Na$^+$ ions, have been characterized (Tombola et al., *Neuron* 45, 379-388 (2005); Tombola et al., *Nature* 445, 546-549 (2007)). In one embodiment, an ion channel having an omega leak suitable for use with the methods described herein will be a Shaker protein comprising an amino acid substitution of one or more S4 helix gating charge amino acid residues at any of positions R362, R365, R368, R371, K374, or R377, wherein the substitution replaces the positively charged arginine residue with an amino acid substituent residue having an uncharged polar side chain or with an amino acid residue not having a positively charged side chain. In one embodiment, the amino acid substitute at the gating charge position is a serine or an asparagine. In one embodiment, the amino acid substitute at the gating charge position is a serine or an asparagine.

In one embodiment, an ion channel having an omega leak suitable for use with the methods described herein will be a Nav1.1 protein comprising an amino acid substitution of one or more S4 helix gating charge amino acid residues at any of positions K1313, R1316, R1319, R1322, or R1325, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Nav1.2 protein comprising an amino acid substitution of one or more S4 helix gating charge amino acid residues at any of positions K1303, R1306, R1309, R1312 or R1315, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Nav1.3 protein comprising an amino acid substitution of one or more S4 helix gating charge amino acid residues at any of positions K1301, R1304, R1307, R1310, or R1313, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Nav1.4 protein comprising an amino acid substitution of one or more S4 helix gating charge amino acid residues at any of positions K1126, R1129, R1132, R1135 or R1137, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Nav1.5 protein comprising an amino acid substitution of one or more S4 helix gating charge amino acid residues at any of positions K1300, R1303, R1306, R1309 and R1312, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Nav1.6 protein comprising an amino acid substitution of one or more S4 helix gating charge amino acid residues at any of positions K1293, 1296, R1299, R1302 or R1305, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Nav1.7 protein comprising an amino acid substitution of one or more S4 helix gating charge amino acid residues at any of positions K1276, R1279, R1282, R1285 or R1288, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Nav1.8 protein comprising an amino acid substitution of one or more S4 helix gating charge amino acid residues at any of positions K1247, R1250, R1253, R1256, or R1259, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Nav1.9 protein comprising an amino acid substitution of one or more S4 helix gating charge amino acid residues at any of positions K1144, R1147, R1150, R1153, or R1156, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Cav1.1 protein comprising an amino acid substitution of one or more S4 helix gating charge amino acid residues at any of positions K912, or K915, wherein the substitution replaces the positively charged lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Cav1.2 protein comprising an amino acid substitution of one or more S4 helix gating charge amino acid residues at any of positions K984 or K987, wherein the substitution replaces the positively charged lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Cav1.3 protein comprising an amino acid substitution of one or more S4 helix gating charge amino acid residues at any of positions K999 or K1002 wherein the substitution replaces the positively charged lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Cav1.4 protein comprising an amino acid substitution of one or more S4 helix gating charge amino acid residues at any of positions K973 or K976, wherein the substitution replaces the positively charged lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv1.1 protein comprising an amino acid substitution of one or more S4 helix gating charge amino acid residues at any of positions R292, R295, R298, R301, K304, or R307, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv1.2 protein comprising an amino acid substitution of one or more S4 helix gating charge amino acid residues at any of positions R294, R297, R300, R303, K306, or R309, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv1.3 protein comprising an amino acid substitution of one or more S4 helix gating charge amino acid residues at any of positions R364, R367, R370, R373, K376, or R379, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv1.4 protein comprising an amino acid substitution of one or more S4 helix gating charge amino acid residues at any of positions R444, R447, R450, R453, K456, or R459, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv1.5 protein comprising an amino acid substitution of one or more S4 helix gating charge amino acid residues at any of positions R400, R403, R406, R409, K412, or R415, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv1.6 protein comprising an amino acid substitution of one or more S4 helix gating charge amino acid residues at any of positions R342, R345, R348, R351, K354 or R357, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv1.7 protein comprising an amino acid substitution of one or more S4 helix gating charge amino acid residues at any of positions R278, R281, R284, R287, K290 or R293, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv1.8 protein comprising an amino acid substitution of one or more S4 helix gating charge amino acid residues at any of positions R341, R344, R347, R350, K353 or R356, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv2.1 protein comprising an amino acid substitution of one or more S4 helix gating charge amino acid residues at any of positions R300, R303, R306, K309 or R312, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv2.2 protein comprising an amino acid substitution of one or more S4 helix gating charge amino acid residues at any of positions R304, R307, R310, K313 or R316, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv3.1 protein comprising an amino acid substitution of one or more S4 helix gating charge amino acid residues at any of positions R311, R314, R317, R320, K323 or R326, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv3.2 protein comprising an amino acid substitution of one or more S4 helix gating charge amino acid residues at any of positions R348, R351, R354, R357, K360 or R363, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv3.3 protein comprising an amino acid substitution of one or more S4 helix gating charge amino acid residues at any of positions R414, R417, R420, R423, K426 or R429, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv3.4 protein comprising an amino acid substitution of one or more S4 helix gating charge amino acid residues at any of positions R347, R350, R353, R356, K359 or R362 wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv4.1 protein comprising an amino acid substitution of one or more S4 helix gating charge amino acid residues at any of positions R295, R298, R301, K304, or R307, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv4.2 protein comprising an amino acid substitution of one or more S4 helix gating charge amino acid residues at any of positions R293, R296, R299, K302 or R305, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv4.3 protein comprising an amino acid substitution of one or more S4 helix gating charge amino acid residues at any of positions R292, R295, R298, K301 or R304, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv5.1 protein comprising an amino acid substitution of one or more S4 helix gating charge amino acid residues at any of positions R293, R296, K299, or R302, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv6.1 protein comprising an amino acid substitution of one or more S4 helix gating charge amino acid residues at any of positions R343, R346, R352 or R355, wherein the substitution replaces the positively charged arginine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv6.2 protein comprising an amino acid substitution of one or more S4 helix gating charge amino acid residues at any of positions R288, R291, R297 or R300, wherein the substitution replaces the positively charged arginine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv6.3 protein comprising an amino acid substitution of one or more S4 helix gating charge amino acid residues at any of positions R289, R292, R295, K301 or R304, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv6.4 protein comprising an amino acid substitution of one or more S4 helix gating charge amino acid residues at any of positions R337, R340, R343, R349 or R352, wherein the substitution replaces the positively charged arginine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv8.1 protein comprising an amino acid substitution of one or more S4 helix gating charge amino acid residues at any of positions R315, R318, R321, K324 or K327, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv8.2 protein comprising an amino acid substitution of one or more S4 helix gating charge amino acid residues at any of positions R377, R380, R383, R386, K389 or R392, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv9.1 protein comprising an amino acid substitution of one or more S4 helix gating charge amino acid residues at any of positions R345, R348, R351, K354 or R357, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv9.2 protein comprising an amino acid substitution of one or more S4 helix gating charge amino acid residues at any of positions R298, R301, R304, K307 or R310, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an omega leak suitable for use with the methods described herein will be a Kv9.3 protein comprising an amino acid substitution of one or more S4 helix gating charge amino acid residues at any of positions R298, R301, R304, K307 or R310, wherein the substitution replaces the positively charged arginine or lysine residue with an amino acid substituent residue having an uncharged polar side chain or with an amino acid residue not having a positively charged side chain. In one embodiment, the amino acid substitute at the gating charge position is a serine or an asparagine.

Other mutations outside of the S4 helix that cause an ion channel to exhibit an omega leak current in a closed and/or inactive configuration include those identified in Tombola et al, Nature 445, 546-549(2007). For example, the *Drosophila* shaker protein can be mutated to exhibit an omega leak current when in a closed and/or inactivated confirmation by introducing one or more of the following mutations: V236C, E283D, C286S, F290C, A359G, Q354C, S357C, S352C, V453C, and W454C.

In one embodiment, an ion channel having an omega leak suitable for use with the methods described herein will be a Shaker protein comprising an amino acid substitution of one or more S4 helix gating charge amino acid residues at any of positions R362, R365, R368, R371, K374, or R377, wherein the substitution replaces the positively charged arginine or lysine residue with an amino acid residue having an uncharged polar side chain or with an amino acid residue not having a positively charged side chain. In one embodiment, the amino acid substitution at the gating charge position is a serine (e.g. R362S) or an asparagine (e.g. R362N). In one embodiment, the ion channel has an omega leak and an open alpha pore. For example, the *Drosophila* Shaker protein can be mutated to have an omega leak and an open alpha pore by introducing the mutation R362S. Other mutations can cause an ion channel to have a closed alpha pore. For example, the *Drosophila* Shaker protein can be mutated to exhibit a closed alpha pore by introduction of the mutation W434F. In one embodiment, the ion channel has an omega leak and a closed alpha pore. For example, the *Drosophila* Shaker protein can be mutated to have an omega leak and a closed alpha pore by introducing the mutations R362S and W434F. In some embodiments, the Shaker protein with mutations R362S can be used for drug screening.

In one embodiment, an ion channel having omega pore dependent permeation suitable for use with the methods described herein will be a Nav1.1 protein comprising at least one of the following amino acid substitutions: L911C, R1188D, C1191S, V1196C, A1302C, L1304C, S1307C, K1492C, or F1493C In one embodiment, an ion channel having omega pore dependent permeation suitable for use with the methods described herein will be a Nav1.2 protein comprising at least one of the following amino acid substitutions: L902C, K1178D, C1188S, I1186C, N1192C, L1194C, S1197C, K1482C, or F1483C In one embodiment, an ion channel having omega pore dependent permeation suitable for use with the methods described herein will be a Nav1.3 protein comprising at least one of the following amino acid substitutions: L903C, K1176D, F1179S, T1184C, N1190C, L1192C, S1195C, K1477C, or F1478C.

In one embodiment, an ion channel having omega pore dependent permeation suitable for use with the methods described herein will be a Nav1.4 protein comprising at least one of the following amino acid substitutions: L721C, R1001D, C1004S, I1009C, N1115C, L1117C, S1120C, K1304C, or L1305C.

In one embodiment, an ion channel having omega pore dependent permeation suitable for use with the methods described herein will be a Nav1.5 protein comprising at least one of the following amino acid substitutions: L860C, R1175D, C1178S, T1183C, N1298C, L1300C, A1303C, K1479C, or L1480C.

In one embodiment, an ion channel having omega pore dependent permeation suitable for use with the methods described herein will be a Nav1.6 protein comprising at least one of the following amino acid substitutions: L896C, R1168D, C1171S, I1176C, N1282C, L1284C, S1287C, K1473C, or F1474C.

In one embodiment, an ion channel having omega pore dependent permeation suitable for use with the methods described herein will be a Nav1.7 protein comprising at least one of the following amino acid substitutions: L876C, R1151D, C1154S, I1159C, N1265C, L1267C, S1270C, K1455C, or L1456C.

In one embodiment, an ion channel having omega pore dependent permeation suitable for use with the methods described herein will be a Nav1.8 protein comprising at least one of the following amino acid substitutions: L808C, H1123D, C1126S, T1130C, K1236C, L1238C, S1241C, A1243G, K1437C, or L1438C.

In one embodiment, an ion channel having omega pore dependent permeation suitable for use with the methods described herein will be a Nav1.9 protein comprising at least one of the following amino acid substitutions: L722C, G1022D, C1125S, D1033C, T1135C, L1137C, L1140C, M1141G, K1337C, or L1338C.

In one embodiment, an ion channel having omega pore dependent permeation suitable for use with the methods described herein will be a Cav1.1 protein comprising at least one of the following amino acid substitutions: N622C, F782D, T785S, K894C, L896C, L899C, N909G, I1114C, or V1115C.

In one embodiment, an ion channel having omega pore dependent permeation suitable for use with the methods described herein will be a Cav1.2 protein comprising at least one of the following amino acid substitutions: D685C, F854D, N857S, K966C, L968C, L971C, N981G, V1186C, or V1187C.

In one embodiment, an ion channel having omega pore dependent permeation suitable for use with the methods described herein will be a Cav1.3 protein comprising at least one of the following amino acid substitutions: D713C, L869D, T872S, K981C, L983C, L986C, N996G, V1201C, or V1202C.

In one embodiment, an ion channel having omega pore dependent permeation suitable for use with the methods described herein will be a Cav1.4 protein comprising at least one of the following amino acid substitutions: D708C, L843D, T846S, K955C, L953C, L956C, N966G, T1175C, or V1176C.

In one embodiment, an ion channel having omega pore dependent permeation suitable for use with the methods described herein will be a Cav2.1 protein comprising at least one of the following amino acid substitutions: D676C, L1230D, T1233S, K1346C, L1348C, L1351C, K1361G, F1565C, or V1566C.

In one embodiment, an ion channel having omega pore dependent permeation suitable for use with the methods described herein will be a Cav2.2 protein comprising at least one of the following amino acid substitutions: H671C, L1133D, T1136S, K1248C, L1250C, L1253C, K1263G, F1467C, or V1468C.

In one embodiment, an ion channel having omega pore dependent permeation suitable for use with the methods described herein will be a Cav2.3 protein comprising at least one of the following amino acid substitutions: N665C, F1117D, T1120S, K1236C, L1238C, L1241C, K1251G, F1455C, or V1456C.

In one embodiment, an ion channel having omega pore dependent permeation suitable for use with the methods described herein will be a Cav3.1 protein comprising at least one of the following amino acid substitutions: G827C, K974D, D977S, D990C, T1069C, S1071C, S1074C, M1083G, K1328C, or V1329C.

In one embodiment, an ion channel having omega pore dependent permeation suitable for use with the methods described herein will be a Cav3.2 protein comprising at least one of the following amino acid substitutions: D877C, G1022D, N1025S, T1028C, R1105C, S1107C, S1110C, Q1118G, K1346C, or V1347C.

In one embodiment, an ion channel having omega pore dependent permeation suitable for use with the methods described herein will be a Cav3.3 protein comprising at least one of the following amino acid substitutions: D689C, G834D, N837S, S840C, K916C, S918C, S921C, S926G, K1187C, or V1188C.

In one embodiment, an ion channel having omega pore dependent permeation suitable for use with the methods described herein will be a Kv1.1 protein comprising at least one of the following amino acid substitutions: V176C, E225D, C228S, F232C, Q284C, S287C, A289G, I383C, or G384C.

In one embodiment, an ion channel having omega pore dependent permeation suitable for use with the methods described herein will be a Kv1.2 protein comprising at least one of the following amino acid substitutions: V172C, E226D, C229S, F233C, Q286C, S289C, A291G, I385C, or G386C.

In one embodiment, an ion channel having omega pore dependent permeation suitable for use with the methods described herein will be a Kv1.3 protein comprising at least one of the following amino acid substitutions: V243C, E299D, C302S, F306C, Q356C, S359C, A361G, I455C, or G456C.

In one embodiment, an ion channel having omega pore dependent permeation suitable for use with the methods described herein will be a Kv1.4 protein comprising at least one of the following amino acid substitutions: V316C, E375D, C378S, F382C, Q434C, Q436C, S439C, A441G, V555C, or G556C.

In one embodiment, an ion channel having omega pore dependent permeation suitable for use with the methods described herein will be a Kv1.5 protein comprising at least one of the following amino acid substitutions: V259C, E328D, C331S, F335C, G390C, Q392C, S395C, A397G, V491C, or G492C.

In one embodiment, an ion channel having omega pore dependent permeation suitable for use with the methods described herein will be a Kv1.6 protein comprising at least one of the following amino acid substitutions: V183C, E267D, C270S, F274C, G332C, Q334C, S337C, A339G, V433C, or G434C.

In one embodiment, an ion channel having omega pore dependent permeation suitable for use with the methods described herein will be a Kv1.7 protein comprising at least one of the following amino acid substitutions: V152C, E213D, C216S, F220C, G268C, Q270C, S237C, A275G, V369C, or G370C.

In one embodiment, an ion channel having omega pore dependent permeation suitable for use with the methods described herein will be a Kv1.8 protein comprising at least one of the following amino acid substitutions: V225C, E275D, C278S, F282C, A331C, Q333C, S336C, A338G, P432C, or G433C.

In one embodiment, an ion channel having omega pore dependent permeation suitable for use with the methods described herein will be a Kv2.1 protein comprising at least one of the following amino acid substitutions: D164C, C236S, F240C, L287C, F289C, V292C, R294G, L388C, or L389C.

In one embodiment, an ion channel having omega pore dependent permeation suitable for use with the methods described herein will be a Kv2.2 protein comprising at least one of the following amino acid substitutions: D168C, C240S, F244C, L291C, F293C, V296C, R298G, L392C, or L393C.

In one embodiment, an ion channel having omega pore dependent permeation suitable for use with the methods described herein will be a Kv3.1 protein comprising at least one of the following amino acid substitutions: F199C, C252S, F256C, K301C, A303C, V306C, W411C, or S412C.

In one embodiment, an ion channel having omega pore dependent permeation suitable for use with the methods described herein will be a Kv3.2 protein comprising at least one of the following amino acid substitutions: F238C, C289S, F293C, K338C, A340C, V343C, W448C, or S449C.

In one embodiment, an ion channel having omega pore dependent permeation suitable for use with the methods described herein will be a Kv3.3 protein comprising at least one of the following amino acid substitutions: F299C, C355S, F347C, K404C, A406C, V409C, W514C, or S515C.

In one embodiment, an ion channel having omega pore dependent permeation suitable for use with the methods described herein will be a Kv3.4 protein comprising at least one of the following amino acid substitutions: F235C, C285S, F292C, K337C, A339C, V347C, W447C, or S448C.

In one embodiment, an ion channel having omega pore dependent permeation suitable for use with the methods described herein will be a Kv4.1 protein comprising at least one of the following amino acid substitutions: H180C, V239S, F242C, K283C, D285C, S288C, A290G, I383C, or A384C.

In one embodiment, an ion channel having omega pore dependent permeation suitable for use with the methods described herein will be a Kv4.2 protein comprising at least one of the following amino acid substitutions: H179C, V237S, F240C, D281C, E283C, S286C, A288G, I381C, or A382C.

In one embodiment, an ion channel having omega pore dependent permeation suitable for use with the methods described herein will be a Kv4.3 protein comprising at least one of the following amino acid substitutions: H177C, V234S, F237C, N278C, E280C, S283C, A285G, I378C, or A379C.

In one embodiment, an ion channel having omega pore dependent permeation suitable for use with the methods described herein will be a Kv5.1 protein comprising at least one of the following amino acid substitutions: L191C, F233C, V285C, Q287C, Q290C, T381C, or L382C.

In one embodiment, an ion channel having omega pore dependent permeation suitable for use with the methods described herein will be a Kv6.1 protein comprising at least one of the following amino acid substitutions: G226C, C275S, F279C, Y334C, D336C, G339C, V341G, T435C, or P436C.

In one embodiment, an ion channel having omega pore dependent permeation suitable for use with the methods described herein will be a Kv6.2 protein comprising at least one of the following amino acid substitutions: G176C, C225S, F229C, L279C, E280C, G283C, V286G, L380C, or P381C.

In one embodiment, an ion channel having omega pore dependent permeation suitable for use with the methods described herein will be a Kv6.3 protein comprising at least one of the following amino acid substitutions: F180C, C228S, F232C, Q280C, Q282C, G285C, V286G, V384C, or P385C.

In one embodiment, an ion channel having omega pore dependent permeation suitable for use with the methods described herein will be a Kv6.4 protein comprising at least one of the following amino acid substitutions: G220C, C269S, F273C, Y328C, E330C, G333C, V335G, V429C, or P430C.

In one embodiment, an ion channel having omega pore dependent permeation suitable for use with the methods described herein will be a Kv7.1 protein comprising at least one of the following amino acid substitutions: V212C, E284C, K326C, I328C, C331C, F456C, or S457C.

In one embodiment, an ion channel having omega pore dependent permeation suitable for use with the methods described herein will be a Kv7.2 protein comprising at least one of the following amino acid substitutions: W270C, W344S, L393C, R395C, K398C, K537C, or V538C.

In one embodiment, an ion channel having omega pore dependent permeation suitable for use with the methods described herein will be a Kv7.3 protein comprising at least one of the following amino acid substitutions: W309C, W383S, A418C, S421C, Y541C, or D542C.

In one embodiment, an ion channel having omega pore dependent permeation suitable for use with the methods described herein will be a Kv7.4 protein comprising at least one of the following amino acid substitutions: W274C, W350S, V386C, R388C, N391C, T463C, or S464C.

In one embodiment, an ion channel having omega pore dependent permeation suitable for use with the methods described herein will be a Kv7.5 protein comprising at least one of the following amino acid substitutions: W304C, W378S, K428C, R430C, M433C, Y544C, or D545C.

In one embodiment, an ion channel having omega pore dependent permeation suitable for use with the methods described herein will be a Kv8.1 protein comprising at least one of the following amino acid substitutions: T191C, Y248S, F253C, G308C, I310C, V313C, T403C, or T404C.

In one embodiment, an ion channel having omega pore dependent permeation suitable for use with the methods described herein will be a Kv8.2 protein comprising at least one of the following amino acid substitutions: G240C, C309S, S368C, G370C, G373C, H468C, or L469C.

In one embodiment, an ion channel having omega pore dependent permeation suitable for use with the methods described herein will be a Kv9.1 protein comprising at least one of the following amino acid substitutions: S219C, C279S, F283C, H336C, G338C, V341C, V343G, V433C, or A434C.

In one embodiment, an ion channel having omega pore dependent permeation suitable for use with the methods described herein will be a Kv9.2 protein comprising at least one of the following amino acid substitutions: S186C, L240S, F246C, N289C, G291C, A294C, V296G, T386C, or A387C.

In one embodiment, an ion channel having omega pore dependent permeation suitable for use with the methods described herein will be a Kv9.3 protein comprising at least one of the following amino acid substitutions: S186C, L240S, F246C, N289C, G291C, A294C, V296G, T386C, or A387C.

In one embodiment, an ion channel having omega pore dependent permeation suitable for use with the methods described herein will be a Kv10.1 protein comprising at least one of the following amino acid substitutions: I281C, H391S, S435C, S437C, W440C, M563C, or R564C.

In one embodiment, an ion channel having omega pore dependent permeation suitable for use with the methods described herein will be a Kv10.2 protein comprising at least one of the following amino acid substitutions: I287C, H361S, T404C, A406C, W409C, M532C, or R533C.

In one embodiment, an ion channel having omega pore dependent permeation suitable for use with the methods described herein will be a Kv11.1 protein comprising at least one of the following amino acid substitutions: V483C, H562S, Y597C, S599C, L602C, L724C, or Q725C.

In one embodiment, an ion channel having omega pore dependent permeation suitable for use with the methods described herein will be a Kv11.2 protein comprising at least one of the following amino acid substitutions: V311C, H413S, Y448C, S450C, P453C, L576C, or Q577C.

In one embodiment, an ion channel having omega pore dependent permeation suitable for use with the methods described herein will be a Kv11.3 protein comprising at least one of the following amino acid substitutions: V482C, H564S, Y599C, D601C, S604C, L727C, or Q728C.

In one embodiment, an ion channel having omega pore dependent permeation suitable for use with the methods described herein will be a Kv12.1 protein comprising at least one of the following amino acid substitutions: I288C, H368S, Y406C, G408C, T411C, L534C, or R535C.

In one embodiment, an ion channel having omega pore dependent permeation suitable for use with the methods described herein will be a Kv12.2 protein comprising at least one of the following amino acid substitutions: V292C, H372S, N428C, S430C, S433C, L443G, L565C, or R566C.

In one embodiment, an ion channel having omega pore dependent permeation suitable for use with the methods described herein will be a Kv12.3 protein comprising at least one of the following amino acid substitutions: I294C, H374S, Y412C, N414C, V417C, L535C, or R536C.

In one embodiment, an ion channel having omega pore dependent permeation suitable for use with the methods described herein will be a HCN1 protein comprising at least one of the following amino acid substitutions: V311C, T394S, Y434C, E436C, Y439C, T545C, or K546C.

In one embodiment, an ion channel having omega pore dependent permeation suitable for use with the methods described herein will be a HCN2 protein comprising at least one of the following amino acid substitutions: V400C, T436S, Y503C, E505C, Y508C, T614C, or R615C.

In one embodiment, an ion channel having omega pore dependent permeation suitable for use with the methods described herein will be a HCN3 protein comprising at least one of the following amino acid substitutions: V284C, T347S, Y387C, E389C, Y392C, T498C, or R499C.

In one embodiment, an ion channel having omega pore dependent permeation suitable for use with the methods described herein will be a HCN4 protein comprising at least one of the following amino acid substitutions: V451C, T514S, Y554C, E556C, Y559C, T665C, or R666C.

In one embodiment, an ion channel having omega pore dependent permeation suitable for use with the methods described herein will be a CatSper1 protein comprising at least one of the following amino acid substitutions: H214C, Y277S, Y313C, H315C, Y318C, P328G, W426C, or E427C.

In one embodiment, an ion channel having omega pore dependent permeation suitable for use with the methods described herein will be a CatSper2 protein comprising at least one of the following amino acid substitutions: K239C, T289S, S334C, I336C, M339C, S433C, or K434C.

In one embodiment, an ion channel having omega pore dependent permeation suitable for use with the methods described herein will be a CatSper3 protein comprising at least one of the following amino acid substitutions: L151C, F196C, K234C, L236C, R239C, T330C, or L331C.

In one embodiment, an ion channel having omega pore dependent permeation suitable for use with the methods described herein will be a CatSper4 protein comprising at least one of the following amino acid substitutions: N146C, S229C, F231C, T234C, or E327C.

In one embodiment, an ion channel having omega pore dependent permeation suitable for use with the methods described herein will be a Hv1 protein comprising at least one of the following amino acid substitutions: V103C, K157C, F159C, R162C, S250C, or E251C.

In one embodiment, an ion channel having omega pore dependent permeation suitable for use with the methods described herein will be a KCa1.1 protein comprising at least one of the following amino acid substitutions: G399C, D485S, P498C, Y593C, E595C, S598C, S610G, H787C, or V788C.

In one embodiment, an ion channel having omega pore dependent permeation suitable for use with the methods described herein will be a KCa4.1 protein comprising at least one of the following amino acid substitutions: V500C, H586S, F635C, F637C, E640C, T809C, or A810C.

In one embodiment, an ion channel having omega pore dependent permeation suitable for use with the methods described herein will be a KCa4.2 protein comprising at least one of the following amino acid substitutions: I428C, H514S, F563C, N565C, Q568C, T727C, or A728C.

In one embodiment, an ion channel having omega pore dependent permeation suitable for use with the methods described herein will be a TPC1 protein comprising at least one of the following amino acid substitutions: S363C, N461S, L468C, Y520C, V522C, V525C, F355G, Y698C, or L699C.

VGIC function has been implicated in a variety of channelopathies including, but not limited to, cardiac arrhythmias, familial periodic paralyses, cystic fibrosis, epilepsy, diabetes, asthma, angina pectoris, malignant hyperthermia, pain, hypertension, epilepsy, etc. Ion channels represent key molecular targets for drug discovery. For example, Kv1.3 channel function can play a role in T-cell immunosuppression, Kv2.1 channel function can play a role in Type 2 diabetes, Kv1.5 channel function can play a role in Atrial fibrillation, Kv3.4 channel function can play a role in Alzheimer's disease, Kv7.1 channel function can play a role in atrial arrhythmia, Kv7.2 and Kv7.3 channel function can play a role in memory disorders, epilepsy, pain and migraine, Kv10.1 channel function can play a role in cancer, V-gated Na+/Ca2+ channels channel function can play a role in pain and hypertension, TRP channels channel function can play a role in pain and inflammation, CRAC channel function can play a role in T-cell immunosuppression. Thus, where mutations associated with VGIC function have been identified art, such mutants can be used in connection with the methods described herein.

Several human channelopathies are typically associated with strictly analogous mutations in the gating charge arginine or lysine residues located in the S4-helix of the VSDs of various human VGSCs. These mutations allow omega dependent permeation when the channel is in the resting state, for certain mutations, or in the activated state, for certain other mutations. Such gain-of-function mutants substantially increase resting membrane conductance, leading to, for instance, cardiac long QT syndromes, various paralyses, and migraine. One such example is the R850Q/R853Q double mutant of the Nav1.2a channel; this double mutation supports currents carried by K+, Cs+, Li+, Na+, tetramethylammonium, and tetraethylammonium, all in the presence of the alpha-pore blocker tetrodotoxin, thus demonstrating that these abnormal currents are omega currents (S. Sokolov, T. Scheuer, W. A. Catterall, Ion permeation through a voltage-sensitive gating pore in brain sodium channels having voltage sensor mutations. *Neuron* 47, 183-189 (2005)). Mutations in the Nav1.4 channel, including R663H, R666G, R666H, and R666S, are associated with hypokalaemic periodic paralysis; all these mutations exhibit omega dependent permeation in the presence of the alpha-pore blocker tetrodotoxin (S. Sokolov, T. Scheuer, W. A. Catterall, Gating pore current in an inherited ion channelopathy. *Nature* 446, 76-78 (2007)). Additional, similar mutations have been discussed (S. C. Cannon, Voltage-sensor mutations in channelopathies of skeletal muscle. *J. Physiol.* 588, 1887-1895 (2010)), including those in Table 1.

TABLE 1

Gating charge mutations in ion channelopathies.

| Disease | Gene | Channel | Mutation(s) | Location |
|---|---|---|---|---|
| HypoPP type I | CACNA1S | Cav1.1 | R528H/G<br>R1239H/G | IIS4 R1<br>IVS4 R2 |
| HypoPP type II | SCN4A | Nav1.4 | R669H<br>R672H/G/S/C | IIS4 R1<br>IIS4 R2 |
| K+-sensitive Normokalemic PP | SCN4A | Nav1.4 | R675G/Q/W | IIS4 R3 |
| HyperPP/Paramyotonia Congenita | SCN4A | Nav1.4 | R1448C/H | IVS4 R1 |
| Generalized Epilepsy with Febrile Seizures Plus | SCN1A | Nav1.1 | R859C | IIS4 R1 |
| | | | R1648H | IVS4 R5 |
| Familial Hemiplegic Migraine/ Progressive Cerebellar Ataxia | CACNA1A | Cav2.1 | R192Q | IS4 R1 |
| | | | R583Q<br>R1347Q | IIS4 R1<br>IIIS4 R1 |
| Long QT 1 | KCNQ1 | KV7.1 | R231C | S4 R2 |
| Long QT 2 | KCNH2 | KV11.1 | K525N<br>R528P | S4 R0<br>S4 R1 |
| Long QT 3 | SCN5A | Nav1.5 | R225Q<br>R1623Q | IS4 R3<br>IVS4 R0 |

The gating charge mutations in ion channelopathies are from the collection of ion channelopathy mutations listed in the OMIM database at http://www ncbi nlm nih.gov. Mutations that would alter an S4 gating charge in a voltage-gated Na+, Ca2+, or K+ channel were selected. 13 of the 16 disease mutations are in the R1 or R2 position in the S4 voltage sensor, and therefore would cause gating pore current in the resting state of the ion channel like the HypoPP mutations studied here (S. Sokolov, T. Scheuer, W. A. Catterall, Gating pore current in an inherited ion channelopathy. *Nature* 446, 76-78 (2007)).

The channelopathy associated mutations shown in Table 1 are not intended to be limiting and other channelopathy associated mutations capable of inducing omega or sigma dependent permeation known in the art can be used in connection with the methods described herein. Further, because one of skill in the art will readily be capable of aligning the sequence of any of the voltage-gated ion channel proteins shown in Table 1 against other VGPs or VGICs, the methods described herein can also be performed by generating a mutated VGIC protein comprising one or more substitutions analogous to the channelopathy associated mutations set forth in Table 1. Thus, in certain embodiments, the methods described herein can be performed with a Nav1.1, Nav1.2, Nav1.3, Nav1.4, Nav1.5, Nav1.6, Nav1.7, Nav1.8, Nav1.9, Cav1.1, Cav1.2, Cav1.3, Cav1.4, Cav2.1, Cav2.2, Cav2.3, Cav3.1, Cav3.2, Cav3.3, Kv1.1, Kv1.2, Kv1.3, Kv1.4, Kv1.5, Kv1.6, Kv1.7, Kv1.8, Kv2.1, Kv2.2, Kv3.1, Kv3.2, Kv3.3, Kv3.4, Kv4.1, Kv4.2, Kv4.3, Kv5.1, Kv6.1, Kv6.2, Kv6.3, Kv6.4, Kv7.1, Kv7.2, Kv7.3, Kv7.4, Kv7.5, Kv8.1, Kv8.2, Kv9.1, Kv9.2, Kv9.3, Kv10.1, Kv10.2, Kv11.1, Kv11.2, Kv11.3, Kv12.1, Kv12.2, Kv12.3, HCN1, HCN2, HCN3, HCN4, CatSper1, CatSper2, CatSper3, CatSper4, Hv1, KCa1.1, KCa4.1, KCa4.2, TPC1, *Drosophila* Shaker or any other VGIC or VGP comprising one or more amino acid substitutions analogous to those set forth in Table 1 as determined by sequence alignment.

Other methods for generating ion channels having an omega leak current include chemical modification of ion channels with thiol reactive agents such as ((2-trimethylammonium)ethyl)-methanethiosulphonate (MTSET) or (2-sulphonatoethyl)-methanethiosulphonate (MTSES). Without wishing to be bound by theory, MTSET and MTSES thiol reactive agents can modify ion channels by adding bulk and either a positive or negative charge to residues having a thiol group (e.g. cysteine). In the case of MTSET, the addition will be bulk and a positive charge. In the case of MTSES, the addition will be bulk and a negative charge. Mutations that can be introduced into the *Drosophila* shaker ion channel that will render the ion channel susceptible to MTSET treatment induced omega leak currents are known in the art, and include, Q354C, S352C, V453C, M356C as well as other mutations described in Tombola et al, Nature 445, 546-549(2007). Mutations that can be introduced into the *Drosophila* shaker ion channel that will render the ion channel susceptible to MTSES treatment induced omega leak currents are known in the art, and include, Q354C, S352C, V453C, W454C as well as other mutations described in Tombola et al, Nature 445, 546-549(2007). Because one of skill in the art will readily be capable aligning two or more amino acid sequences according to primary sequence and/or predicted or known secondary structural features of an ion channel the residues corresponding to V236, E283, C286, F290, A359, 5352, Q354, M356, V453, W454 and other residues identified in Tombola et al, Nature 445, 546-549 (2007) can readily be mapped to other ion channel proteins to generate ion channels that exhibit omega leak currents either in the presence or absence of treatment with MTSET or in the absence or presence of treatment with MTSES. For example, one of skill in the art will appreciate that residues E283, C286, F290, A359, Q354 in the *Drosophila* shaker protein correspond to residues E229, C232. F236, Q284, respectively. Similar methods can be used to identify residues in other ion channel proteins to generate ion channels exhibiting an omega leak current in a closed and/or inactivated state either in the presence or absence of treatment with MTSET or in the absence or presence of treatment with MTSES.

In one embodiment, an ion channel having omega pore dependent permeation suitable for use with the methods described herein will be a Nav1.1 protein comprising any A1302C, L1304C, Y1306C, K1492C substitution or any combination thereof that has been treated with MTSET.

In one embodiment, an ion channel having omega pore dependent permeation suitable for use with the methods described herein will be a Nav1.2 protein comprising any N1192C, L1194C, Y1196C, K1482C substitution or any combination thereof that has been treated with MTSET.

In one embodiment, an ion channel having omega pore dependent permeation suitable for use with the methods described herein will be a Nav1.3 protein comprising any N1190C, L1192C, Y1194C, K1477C substitution or any combination thereof that has been treated with MTSET.

In one embodiment, an ion channel having omega pore dependent permeation suitable for use with the methods described herein will be a Nav1.4 protein comprising any N1115C, L1117C, Y1119C, K1304C substitution or any combination thereof that has been treated with MTSET.

In one embodiment, an ion channel having omega pore dependent permeation suitable for use with the methods described herein will be a Nav1.5 protein comprising any N1298C, L1300C, Y1302C, K1479C substitution or any combination thereof that has been treated with MTSET.

In one embodiment, an ion channel having omega pore dependent permeation suitable for use with the methods described herein will be a Nav1.6 protein comprising any N1282C, L1284C, Y1286C, K1473C substitution or any combination thereof that has been treated with MTSET.

In one embodiment, an ion channel having omega pore dependent permeation suitable for use with the methods described herein will be a Nav1.7 protein comprising any N1265C, L1267C, Y1269C, K1455C substitution or any combination thereof that has been treated with MTSET.

In one embodiment, an ion channel having omega pore dependent permeation suitable for use with the methods described herein will be a Nav1.8 protein comprising any K1236C, L1238C, Y1240C, K1437C substitution or any combination thereof that has been treated with MTSET.

In one embodiment, an ion channel having omega pore dependent permeation suitable for use with the methods described herein will be a Nav1.9 protein comprising any T1135C, L1137C, N1139C, K1337C substitution or any combination thereof that has been treated with MTSET.

In one embodiment, an ion channel having omega pore dependent permeation suitable for use with the methods described herein will be a Cav1.1 protein comprising any K894C, L896C, V898C, I1114C substitution or any combination thereof that has been treated with MTSET.

In one embodiment, an ion channel having omega pore dependent permeation suitable for use with the methods described herein will be a Cav1.2 protein comprising any K966C, L968C, V970C, V1186C substitution or any combination thereof that has been treated with MTSET.

In one embodiment, an ion channel having omega pore dependent permeation suitable for use with the methods described herein will be a Cav1.3 protein comprising any K981C, L983C, V985C, V1201C substitution or any combination thereof that has been treated with MTSET.

In one embodiment, an ion channel having omega pore dependent permeation suitable for use with the methods described herein will be a Cav1.4 protein comprising any K955C, L957C, V959C, T1175C substitution or any combination thereof that has been treated with MTSET.

In one embodiment, an ion channel having omega pore dependent permeation suitable for use with the methods described herein will be a Cav2.1 protein comprising any K1346C, L1348C, V1350C, F1565C substitution or any combination thereof that has been treated with MTSET.

In one embodiment, an ion channel having omega pore dependent permeation suitable for use with the methods described herein will be a Cav2.2 protein comprising any K1248C, L1250C, V1252C, F1467C substitution or any combination thereof that has been treated with MTSET.

In one embodiment, an ion channel having omega pore dependent permeation suitable for use with the methods described herein will be a Cav2.3 protein comprising any K1236C, L1238C, V1240C, F1455C substitution or any combination thereof that has been treated with MTSET.

In one embodiment, an ion channel having omega pore dependent permeation suitable for use with the methods described herein will be a Cav3.1 protein comprising any T1069C, S1071C, G1073C, K1328C substitution or any combination thereof that has been treated with MTSET.

In one embodiment, an ion channel having omega pore dependent permeation suitable for use with the methods described herein will be a Cav3.2 protein comprising any R1105C, S1107C, S1109C, K1346C substitution or any combination thereof that has been treated with MTSET.

In one embodiment, an ion channel having omega pore dependent permeation suitable for use with the methods described herein will be a Cav3.3 protein comprising any K916C, S918C, M920C, K1187C substitution or any combination thereof that has been treated with MTSET.

In one embodiment, an ion channel having omega pore dependent permeation suitable for use with the methods described herein will be a Kv1.1 protein comprising any Q284C, T286C, 1383C substitution or any combination thereof that has been treated with MTSET.

In one embodiment, an ion channel having omega pore dependent permeation suitable for use with the methods described herein will be a Kv1.2 protein comprising any Q286C, T288C, 1385C substitution or any combination thereof that has been treated with MTSET.

In one embodiment, an ion channel having omega pore dependent permeation suitable for use with the methods described herein will be a Kv1.3 protein comprising any Q356C, T358C, 1455C substitution or any combination thereof that has been treated with MTSET.

In one embodiment, an ion channel having omega pore dependent permeation suitable for use with the methods described herein will be a Kv1.4 protein comprising any Q434C, Q436C, M438C, V555C substitution or any combination thereof that has been treated with MTSET.

In one embodiment, an ion channel having omega pore dependent permeation suitable for use with the methods described herein will be a Kv1.5 protein comprising any G390C, Q392C, M394C, V491C substitution or any combination thereof that has been treated with MTSET.

In one embodiment, an ion channel having omega pore dependent permeation suitable for use with the methods described herein will be a Kv1.6 protein comprising any G332C, Q334C, M336C, V433C substitution or any combination thereof that has been treated with MTSET.

In one embodiment, an ion channel having omega pore dependent permeation suitable for use with the methods described herein will be a Kv1.7 protein comprising any G268C, Q270C, M272C, V369C substitution or any combination thereof that has been treated with MTSET.

In one embodiment, an ion channel having omega pore dependent permeation suitable for use with the methods described herein will be a Kv1.8 protein comprising any A331C, Q333C, M335C, P432C substitution or any combination thereof that has been treated with MTSET.

In one embodiment, an ion channel having omega pore dependent permeation suitable for use with the methods described herein will be a Kv2.1 protein comprising any L287C, F289C, N291C, L388C substitution or any combination thereof that has been treated with MTSET.

In one embodiment, an ion channel having omega pore dependent permeation suitable for use with the methods described herein will be a Kv2.2 protein comprising any L291C, F293C, N295C, L392C substitution or any combination thereof that has been treated with MTSET.

In one embodiment, an ion channel having omega pore dependent permeation suitable for use with the methods described herein will be a Kv3.1 protein comprising any K301C, A303C, D305C, W411C substitution or any combination thereof that has been treated with MTSET.

In one embodiment, an ion channel having omega pore dependent permeation suitable for use with the methods described herein will be a Kv3.2 protein comprising any K338C, A340C, D342C, W448C substitution or any combination thereof that has been treated with MTSET.

In one embodiment, an ion channel having omega pore dependent permeation suitable for use with the methods described herein will be a Kv3.3 protein comprising any K404C, A406C, D408C, W514C substitution or any combination thereof that has been treated with MTSET.

In one embodiment, an ion channel having omega pore dependent permeation suitable for use with the methods described herein will be a Kv3.4 protein comprising any K337C, A339C, D341C, W447C substitution or any combination thereof that has been treated with MTSET.

In one embodiment, an ion channel having omega pore dependent permeation suitable for use with the methods described herein will be a Kv4.1 protein comprising any K283C, D285C, V287C, I383C substitution or any combination thereof that has been treated with MTSET.

In one embodiment, an ion channel having omega pore dependent permeation suitable for use with the methods described herein will be a Kv4.2 protein comprising any D281C, E283C, V285C, I381C substitution or any combination thereof that has been treated with MTSET.

In one embodiment, an ion channel having omega pore dependent permeation suitable for use with the methods described herein will be a Kv4.3 protein comprising any N278C, E280C, V282C, I378C substitution or any combination thereof that has been treated with MTSET.

In one embodiment, an ion channel having omega pore dependent permeation suitable for use with the methods described herein will be a Kv5.1 protein comprising any V285C, Q287C, V289C, T381C substitution or any combination thereof that has been treated with MTSET.

In one embodiment, an ion channel having omega pore dependent permeation suitable for use with the methods described herein will be a Kv6.1 protein comprising any Y334C, D336C, V338C, T435C substitution or any combination thereof that has been treated with MTSET.

In one embodiment, an ion channel having omega pore dependent permeation suitable for use with the methods described herein will be a Kv6.2 protein comprising any L279C, E280C, A282C, L380C substitution or any combination thereof that has been treated with MTSET.

In one embodiment, an ion channel having omega pore dependent permeation suitable for use with the methods described herein will be a Kv6.3 protein comprising any Q280C, Q282C, A284C, V384C substitution or any combination thereof that has been treated with MTSET.

In one embodiment, an ion channel having omega pore dependent permeation suitable for use with the methods described herein will be a Kv6.4 protein comprising any Y328C, E330C, V332C, V429C substitution or any combination thereof that has been treated with MTSET.

In one embodiment, an ion channel having omega pore dependent permeation suitable for use with the methods described herein will be a Kv7.1 protein comprising any K326C, I328C, S330C, F456C substitution or any combination thereof that has been treated with MTSET.

In one embodiment, an ion channel having omega pore dependent permeation suitable for use with the methods described herein will be a Kv7.2 protein comprising any L393C, R395C, L397C, K537C substitution or any combination thereof that has been treated with MTSET.

In one embodiment, an ion channel having omega pore dependent permeation suitable for use with the methods described herein will be a Kv7.3 protein comprising any A418C, S420C, Y541C substitution or any combination thereof that has been treated with MTSET.

In one embodiment, an ion channel having omega pore dependent permeation suitable for use with the methods described herein will be a Kv7.4 protein comprising any V386C, R388C, R390C, T463C substitution or any combination thereof that has been treated with MTSET.

In one embodiment, an ion channel having omega pore dependent permeation suitable for use with the methods described herein will be a Kv7.5 protein comprising any K428C, R430C, R432C, Y544C substitution or any combination thereof that has been treated with MTSET.

In one embodiment, an ion channel having omega pore dependent permeation suitable for use with the methods described herein will be a Kv8.1 protein comprising any G308C, I310C, Q312C, T403C substitution or any combination thereof that has been treated with MTSET.

In one embodiment, an ion channel having omega pore dependent permeation suitable for use with the methods described herein will be a Kv8.2 protein comprising any S368C, G370C, V372C, H468C substitution or any combination thereof that has been treated with MTSET.

In one embodiment, an ion channel having omega pore dependent permeation suitable for use with the methods described herein will be a Kv9.1 protein comprising any H336C, G338C, V340C, V433C substitution or any combination thereof that has been treated with MTSET.

In one embodiment, an ion channel having omega pore dependent permeation suitable for use with the methods described herein will be a Kv9.2 protein comprising any N289C, G291C, V293C, T386C substitution or any combination thereof that has been treated with MTSET.

In one embodiment, an ion channel having omega pore dependent permeation suitable for use with the methods described herein will be a Kv9.3 protein comprising any N289C, G291C, V293C, T386C substitution or any combination thereof that has been treated with MTSET.

In one embodiment, an ion channel having omega pore dependent permeation suitable for use with the methods described herein will be a Kv10.1 protein comprising any S435C, S437C, K439C, M563C substitution or any combination thereof that has been treated with MTSET.

In one embodiment, an ion channel having omega pore dependent permeation suitable for use with the methods described herein will be a Kv10.2 protein comprising any T404C, A406C, I408C, M532C substitution or any combination thereof that has been treated with MTSET.

In one embodiment, an ion channel having omega pore dependent permeation suitable for use with the methods described herein will be a Kv11.1 protein comprising any Y597C, S599C, G601C, L724C substitution or any combination thereof that has been treated with MTSET.

In one embodiment, an ion channel having omega pore dependent permeation suitable for use with the methods described herein will be a Kv11.2 protein comprising any Y448C, S450C, D452C, L576C substitution or any combination thereof that has been treated with MTSET.

In one embodiment, an ion channel having omega pore dependent permeation suitable for use with the methods described herein will be a Kv11.3 protein comprising any Y599C, D601C, D603C, L727C substitution or any combination thereof that has been treated with MTSET.

In one embodiment, an ion channel having omega pore dependent permeation suitable for use with the methods described herein will be a Kv12.1 protein comprising any Y406C, G408C, N410C, L534C substitution or any combination thereof that has been treated with MTSET.

In one embodiment, an ion channel having omega pore dependent permeation suitable for use with the methods described herein will be a Kv12.2 protein comprising any N428C, S430C, S432C, L565C substitution or any combination thereof that has been treated with MTSET.

In one embodiment, an ion channel having omega pore dependent permeation suitable for use with the methods described herein will be a Kv12.3 protein comprising any Y412C, N414C, S416C, L535C substitution or any combination thereof that has been treated with MTSET.

In one embodiment, an ion channel having omega pore dependent permeation suitable for use with the methods described herein will be a HCN1 protein comprising any Y434C, E436C, R438C, T545C substitution or any combination thereof that has been treated with MTSET.

In one embodiment, an ion channel having omega pore dependent permeation suitable for use with the methods described herein will be a HCN2 protein comprising any Y503C, E505C, R507C, T614C substitution or any combination thereof that has been treated with MTSET.

In one embodiment, an ion channel having omega pore dependent permeation suitable for use with the methods described herein will be a HCN3 protein comprising any Y387C, E389C, R391C, T498C substitution or any combination thereof that has been treated with MTSET.

In one embodiment, an ion channel having omega pore dependent permeation suitable for use with the methods described herein will be a HCN4 protein comprising any Y554C, E556C, R558C, T665C substitution or any combination thereof that has been treated with MTSET.

In one embodiment, an ion channel having omega pore dependent permeation suitable for use with the methods described herein will be a CatSper1 protein comprising any Y313C, H315C, D317C, W426C substitution or any combination thereof that has been treated with MTSET.

In one embodiment, an ion channel having omega pore dependent permeation suitable for use with the methods described herein will be a CatSper2 protein comprising any S334C, I336C, A338C, S433C substitution or any combination thereof that has been treated with MTSET.

In one embodiment, an ion channel having omega pore dependent permeation suitable for use with the methods described herein will be a CatSper3 protein comprising any K234C, L236C, N238C, T330C substitution or any combination thereof that has been treated with MTSET.

In one embodiment, an ion channel having omega pore dependent permeation suitable for use with the methods described herein will be a CatSper4 protein comprising any S229C, F231C, V233C substitution or any combination thereof that has been treated with MTSET.

In one embodiment, an ion channel having omega pore dependent permeation suitable for use with the methods described herein will be a Hv1 protein comprising any K157C, F159C, F161C, S250C substitution or any combination thereof that has been treated with MTSET.

In one embodiment, an ion channel having omega pore dependent permeation suitable for use with the methods described herein will be a KCa1.1 protein comprising any Y593C, E595C, V597C, H787C substitution or any combination thereof that has been treated with MTSET.

In one embodiment, an ion channel having omega pore dependent permeation suitable for use with the methods described herein will be a KCa4.1 protein comprising any F635C, F637C, Q639C, T809C substitution or any combination thereof that has been treated with MTSET.

In one embodiment, an ion channel having omega pore dependent permeation suitable for use with the methods described herein will be a KCa4.2 protein comprising any F563C, N565C, D567C, T727C substitution or any combination thereof that has been treated with MTSET.

In one embodiment, an ion channel having omega pore dependent permeation suitable for use with the methods described herein will be a TPC1 protein comprising any Y520C, V522C, A524C, Y698C substitution or any combination thereof that has been treated with MTSET.

In one embodiment, an ion channel having omega pore dependent permeation suitable for use with the methods described herein will be a Nav1.1 protein comprising any A1302C, L1304C, K1492C, F1493C substitution or any combination thereof that has been treated with MTSES.

In one embodiment, an ion channel having omega pore dependent permeation suitable for use with the methods described herein will be a Nav1.2 protein comprising any N1192C, L1194C, K1482C, F1483C substitution or any combination thereof that has been treated with MTSES.

In one embodiment, an ion channel having omega pore dependent permeation suitable for use with the methods described herein will be a Nav1.3 protein comprising any N1190C, L1192C, K1477C, F1478C substitution or any combination thereof that has been treated with MTSES.

In one embodiment, an ion channel having omega pore dependent permeation suitable for use with the methods described herein will be a Nav1.4 protein comprising any N1115C, L1117C, K1304C, L1305C substitution or any combination thereof that has been treated with MTSES.

In one embodiment, an ion channel having omega pore dependent permeation suitable for use with the methods described herein will be a Nav1.5 protein comprising any N1298C, L1300C, K1479C, L1480C substitution or any combination thereof that has been treated with MTSES.

In one embodiment, an ion channel having omega pore dependent permeation suitable for use with the methods described herein will be a Nav1.6 protein comprising any N1282C, L1284C, K1473C, F1474C substitution or any combination thereof that has been treated with MTSES.

In one embodiment, an ion channel having omega pore dependent permeation suitable for use with the methods described herein will be a Nav1.7 protein comprising any N1265C, L1267C, K1455C, L1456C substitution or any combination thereof that has been treated with MTSES.

In one embodiment, an ion channel having omega pore dependent permeation suitable for use with the methods described herein will be a Nav1.8 protein comprising any K1236C, L1238C, K1437C, L1438C substitution or any combination thereof that has been treated with MTSES.

In one embodiment, an ion channel having omega pore dependent permeation suitable for use with the methods described herein will be a Nav1.9 protein comprising any T1135C, L1137C, K1337C, L1338C substitution or any combination thereof that has been treated with MTSES.

In one embodiment, an ion channel having omega pore dependent permeation suitable for use with the methods described herein will be a Cav1.1 protein comprising any K894C, L896C, I1114C, V1115C substitution or any combination thereof that has been treated with MTSES.

In one embodiment, an ion channel having omega pore dependent permeation suitable for use with the methods described herein will be a Cav1.2 protein comprising any K966C, L968C, V1186C, V1187C substitution or any combination thereof that has been treated with MTSES.

In one embodiment, an ion channel having omega pore dependent permeation suitable for use with the methods described herein will be a Cav1.3 protein comprising any K981C, L983C, V1201C, V1202C substitution or any combination thereof that has been treated with MTSES.

In one embodiment, an ion channel having omega pore dependent permeation suitable for use with the methods described herein will be a Cav1.4 protein comprising any K955C, L953C, T1175C, V1176C substitution or any combination thereof that has been treated with MTSES.

In one embodiment, an ion channel having omega pore dependent permeation suitable for use with the methods described herein will be a Cav2.1 protein comprising any K1346C, L1348C, F1565C, V1566C substitution or any combination thereof that has been treated with MTSES.

In one embodiment, an ion channel having omega pore dependent permeation suitable for use with the methods described herein will be a Cav2.2 protein comprising any K1248C, L1250C, F1467C, V1468C substitution or any combination thereof that has been treated with MTSES.

In one embodiment, an ion channel having omega pore dependent permeation suitable for use with the methods described herein will be a Cav2.3 protein comprising any K1236C, L1238C, F1455C, V1456C substitution or any combination thereof that has been treated with MTSES.

In one embodiment, an ion channel having omega pore dependent permeation suitable for use with the methods described herein will be a Cav3.1 protein comprising any T1069C, S1071C, K1328C, V1329C substitution or any combination thereof that has been treated with MTSES.

In one embodiment, an ion channel having omega pore dependent permeation suitable for use with the methods described herein will be a Cav3.2 protein comprising any R1105C, S1107C, K1346C, V1347C substitution or any combination thereof that has been treated with MTSES.

In one embodiment, an ion channel having omega pore dependent permeation suitable for use with the methods described herein will be a Cav3.3 protein comprising any K916C, S918C, K1187C, V1188C substitution or any combination thereof that has been treated with MTSES.

In one embodiment, an ion channel having omega pore dependent permeation suitable for use with the methods described herein will be a Kv1.1 protein comprising any Q284C, I383C, G384C substitution or any combination thereof that has been treated with MTSES.

In one embodiment, an ion channel having omega pore dependent permeation suitable for use with the methods described herein will be a Kv1.2 protein comprising any Q286C, I385C, G386C substitution or any combination thereof that has been treated with MTSES.

In one embodiment, an ion channel having omega pore dependent permeation suitable for use with the methods described herein will be a Kv1.3 protein comprising any Q356C, I455C, G456C substitution or any combination thereof that has been treated with MTSES.

In one embodiment, an ion channel having omega pore dependent permeation suitable for use with the methods described herein will be a Kv1.4 protein comprising any Q434C, Q436C, V555C, G556C substitution or any combination thereof that has been treated with MTSES.

In one embodiment, an ion channel having omega pore dependent permeation suitable for use with the methods described herein will be a Kv1.5 protein comprising any G390C, Q392C, V491C, G492C substitution or any combination thereof that has been treated with MTSES.

In one embodiment, an ion channel having omega pore dependent permeation suitable for use with the methods described herein will be a Kv1.6 protein comprising any G332C, Q334C, V433C, G434C substitution or any combination thereof that has been treated with MTSES.

In one embodiment, an ion channel having omega pore dependent permeation suitable for use with the methods described herein will be a Kv1.7 protein comprising any G268C, Q270C, V369C, G370C substitution or any combination thereof that has been treated with MTSES.

In one embodiment, an ion channel having omega pore dependent permeation suitable for use with the methods described herein will be a Kv1.8 protein comprising any A331C, Q333C, P432C, G433C substitution or any combination thereof that has been treated with MTSES.

In one embodiment, an ion channel having omega pore dependent permeation suitable for use with the methods described herein will be a Kv2.1 protein comprising any L287C, F289C, L388C, L389C substitution or any combination thereof that has been treated with MTSES.

In one embodiment, an ion channel having omega pore dependent permeation suitable for use with the methods described herein will be a Kv2.2 protein comprising any L291C, F293C, L392C, L393C substitution or any combination thereof that has been treated with MTSES.

In one embodiment, an ion channel having omega pore dependent permeation suitable for use with the methods described herein will be a Kv3.1 protein comprising any K301C, A303C, W411C, S412C substitution or any combination thereof that has been treated with MTSES.

In one embodiment, an ion channel having omega pore dependent permeation suitable for use with the methods described herein will be a Kv3.2 protein comprising any K338C, A340C, W448C, S449C substitution or any combination thereof that has been treated with MTSES.

In one embodiment, an ion channel having omega pore dependent permeation suitable for use with the methods described herein will be a Kv3.3 protein comprising any K404C, A406C, W514C, S515C substitution or any combination thereof that has been treated with MTSES.

In one embodiment, an ion channel having omega pore dependent permeation suitable for use with the methods described herein will be a Kv3.4 protein comprising any K337C, A339C, W447C, S448C substitution or any combination thereof that has been treated with MTSES.

In one embodiment, an ion channel having omega pore dependent permeation suitable for use with the methods described herein will be a Kv4.1 protein comprising any K283C, D285C, I383C, A384C substitution or any combination thereof that has been treated with MTSES.

In one embodiment, an ion channel having omega pore dependent permeation suitable for use with the methods described herein will be a Kv4.2 protein comprising any D281C, E283C, I381C, A382C substitution or any combination thereof that has been treated with MTSES.

In one embodiment, an ion channel having omega pore dependent permeation suitable for use with the methods described herein will be a Kv4.3 protein comprising any N278C, E280C, I378C, A379C substitution or any combination thereof that has been treated with MTSES.

In one embodiment, an ion channel having omega pore dependent permeation suitable for use with the methods described herein will be a Kv5.1 protein comprising any V285C, Q287C, T381C, L382C substitution or any combination thereof that has been treated with MTSES.

In one embodiment, an ion channel having omega pore dependent permeation suitable for use with the methods described herein will be a Kv6.1 protein comprising any Y334C, D336C, T435C, P436C substitution or any combination thereof that has been treated with MTSES.

In one embodiment, an ion channel having omega pore dependent permeation suitable for use with the methods described herein will be a Kv6.2 protein comprising any L279C, E280C, L380C, P381C substitution or any combination thereof that has been treated with MTSES.

In one embodiment, an ion channel having omega pore dependent permeation suitable for use with the methods described herein will be a Kv6.3 protein comprising any Q280C, Q282C, V384C, P385C substitution or any combination thereof that has been treated with MTSES.

In one embodiment, an ion channel having omega pore dependent permeation suitable for use with the methods described herein will be a Kv6.4 protein comprising any Y328C, E330C, V429C, P430C substitution or any combination thereof that has been treated with MTSES.

In one embodiment, an ion channel having omega pore dependent permeation suitable for use with the methods described herein will be a Kv7.1 protein comprising any K326C, I328C, F456C, S457C substitution or any combination thereof that has been treated with MTSES.

In one embodiment, an ion channel having omega pore dependent permeation suitable for use with the methods described herein will be a Kv7.2 protein comprising any L393C, R395C, K537C, V538C substitution or any combination thereof that has been treated with MTSES.

In one embodiment, an ion channel having omega pore dependent permeation suitable for use with the methods described herein will be a Kv7.3 protein comprising any A418C, Y541C, D542C substitution or any combination thereof that has been treated with MTSES.

In one embodiment, an ion channel having omega pore dependent permeation suitable for use with the methods described herein will be a Kv7.4 protein comprising any V386C, R388C, T463C, S464C substitution or any combination thereof that has been treated with MTSES.

In one embodiment, an ion channel having omega pore dependent permeation suitable for use with the methods described herein will be a Kv7.5 protein comprising any K428C, R430C, Y544C, D545C substitution or any combination thereof that has been treated with MTSES.

In one embodiment, an ion channel having omega pore dependent permeation suitable for use with the methods described herein will be a Kv8.1 protein comprising any G308C, I310C, T403C, T404C substitution or any combination thereof that has been treated with MTSES.

In one embodiment, an ion channel having omega pore dependent permeation suitable for use with the methods described herein will be a Kv8.2 protein comprising any S368C, G370C, H468C, L469C substitution or any combination thereof that has been treated with MTSES.

In one embodiment, an ion channel having omega pore dependent permeation suitable for use with the methods described herein will be a Kv9.1 protein comprising any H336C, G338C, V433C, A434C substitution or any combination thereof that has been treated with MTSES.

In one embodiment, an ion channel having omega pore dependent permeation suitable for use with the methods described herein will be a Kv9.2 protein comprising any N289C, G291C, T386C, A387C substitution or any combination thereof that has been treated with MTSES.

In one embodiment, an ion channel having omega pore dependent permeation suitable for use with the methods described herein will be a Kv9.3 protein comprising any N289C, G291C, T386C, A387C substitution or any combination thereof that has been treated with MTSES.

In one embodiment, an ion channel having omega pore dependent permeation suitable for use with the methods described herein will be a Kv10.1 protein comprising any S435C, S437C, M563C, R564C substitution or any combination thereof that has been treated with MTSES.

In one embodiment, an ion channel having omega pore dependent permeation suitable for use with the methods described herein will be a Kv10.2 protein comprising any T404C, A406C, M532C, R533C substitution or any combination thereof that has been treated with MTSES.

In one embodiment, an ion channel having omega pore dependent permeation suitable for use with the methods described herein will be a Kv11.1 protein comprising any Y597C, S599C, L724C, Q725C substitution or any combination thereof that has been treated with MTSES.

In one embodiment, an ion channel having omega pore dependent permeation suitable for use with the methods described herein will be a Kv11.2 protein comprising any Y448C, S450C, L576C, Q577C substitution or any combination thereof that has been treated with MTSES.

In one embodiment, an ion channel having omega pore dependent permeation suitable for use with the methods described herein will be a Kv11.3 protein comprising any Y599C, D601C, L727C, Q728C substitution or any combination thereof that has been treated with MTSES.

In one embodiment, an ion channel having omega pore dependent permeation suitable for use with the methods described herein will be a Kv12.1 protein comprising any Y406C, G408C, L534C, R535C substitution or any combination thereof that has been treated with MTSES.

In one embodiment, an ion channel having omega pore dependent permeation suitable for use with the methods described herein will be a Kv12.2 protein comprising any N428C, S430C, L565C, R566C substitution or any combination thereof that has been treated with MTSES.

In one embodiment, an ion channel having omega pore dependent permeation suitable for use with the methods described herein will be a Kv12.3 protein comprising any Y412C, N414C, L535C, R536C substitution or any combination thereof that has been treated with MTSES.

In one embodiment, an ion channel having omega pore dependent permeation suitable for use with the methods described herein will be a HCN1 protein comprising any Y434C, E436C, T545C, K546C substitution or any combination thereof that has been treated with MTSES.

In one embodiment, an ion channel having omega pore dependent permeation suitable for use with the methods described herein will be a HCN2 protein comprising any Y503C, E505C, T614C, R615C substitution or any combination thereof that has been treated with MTSES.

In one embodiment, an ion channel having omega pore dependent permeation suitable for use with the methods described herein will be a HCN3 protein comprising any Y387C, E389C, T498C, R499C substitution or any combination thereof that has been treated with MTSES.

In one embodiment, an ion channel having omega pore dependent permeation suitable for use with the methods described herein will be a HCN4 protein comprising any Y554C, E556C, T665C, R666C substitution or any combination thereof that has been treated with MTSES.

In one embodiment, an ion channel having omega pore dependent permeation suitable for use with the methods described herein will be a CatSper1 protein comprising any Y313C, H315C, W426C, E427C substitution or any combination thereof that has been treated with MTSES.

In one embodiment, an ion channel having omega pore dependent permeation suitable for use with the methods described herein will be a CatSper2 protein comprising any S334C, I336C, S433C, K434C substitution or any combination thereof that has been treated with MTSES.

In one embodiment, an ion channel having omega pore dependent permeation suitable for use with the methods described herein will be a CatSper3 protein comprising any K234C, L236C, T330C, L331C substitution or any combination thereof that has been treated with MTSES.

In one embodiment, an ion channel having omega pore dependent permeation suitable for use with the methods described herein will be a CatSper4 protein comprising any S229C, F231C, E327C substitution or any combination thereof that has been treated with MTSES.

In one embodiment, an ion channel having omega pore dependent permeation suitable for use with the methods described herein will be a Hv1 protein comprising any K157C, F159C, S250C, E251C substitution or any combination thereof that has been treated with MTSES.

In one embodiment, an ion channel having omega pore dependent permeation suitable for use with the methods described herein will be a KCa1.1 protein comprising any Y593C, E595C, H787C, V788C substitution or any combination thereof that has been treated with MTSES.

In one embodiment, an ion channel having omega pore dependent permeation suitable for use with the methods described herein will be a KCa4.1 protein comprising any F635C, F637C, T809C, A810C substitution or any combination thereof that has been treated with MTSES.

In one embodiment, an ion channel having omega pore dependent permeation suitable for use with the methods described herein will be a KCa4.2 protein comprising any F563C, N565C, T727C, A728C substitution or any combination thereof that has been treated with MTSES.

In one embodiment, an ion channel having omega pore dependent permeation suitable for use with the methods described herein will be a TPC1 protein comprising any Y520C, V522C, Y698C, L699C substitution or any combination thereof that has been treated with MTSES.

Mutation of the valine corresponding to position 438 in the *Drosophila* Shaker protein is known to induce a sigma current in human Kv1.3 channels 438 (Pruning and Grissmer, J Biol Chem. 2011 Jun. 3; 286(22):20031-42). Sigma pore dependent ion permeation is similar to omega pore dependent ion permeation, however, unlike omega leak inducing mutations, mutations inducing sigma pore leaks are located adjacent to the alpha pore, rather that being located within the VSD.

In one embodiment, an ion channel having sigma pore dependent permeation suitable for use with the methods described herein will be a Shaker protein comprising a V438C substitution.

In one embodiment, an ion channel having sigma pore dependent permeation suitable for use with the methods described herein will be a Nav1.1 protein comprising a V1442C substitution.

In one embodiment, an ion channel having sigma pore dependent permeation suitable for use with the methods described herein will be a Nav1.2 protein comprising a V1432C substitution.

In one embodiment, an ion channel having sigma pore dependent permeation suitable for use with the methods described herein will be a Nav1.3 protein comprising a V1427C substitution.

In one embodiment, an ion channel having sigma pore dependent permeation suitable for use with the methods described herein will be a Nav1.4 protein comprising a V1254C substitution.

In one embodiment, an ion channel having sigma pore dependent permeation suitable for use with the methods described herein will be a Nav1.5 protein comprising a V1429C substitution.

In one embodiment, an ion channel having sigma pore dependent permeation suitable for use with the methods described herein will be a Nav1.6 protein comprising a V1423C substitution.

In one embodiment, an ion channel having sigma pore dependent permeation suitable for use with the methods described herein will be a Nav1.7 protein comprising a V1405C substitution.

In one embodiment, an ion channel having sigma pore dependent permeation suitable for use with the methods described herein will be a Nav1.8 protein comprising a V1377C substitution.

In one embodiment, an ion channel having sigma pore dependent permeation suitable for use with the methods described herein will be a Nav1.9 protein comprising a V1267C substitution.

In one embodiment, an ion channel having sigma pore dependent permeation suitable for use with the methods described herein will be a Cav1.1 protein comprising a N1037C substitution.

In one embodiment, an ion channel having sigma pore dependent permeation suitable for use with the methods described herein will be a Cav1.2 protein comprising a Y1109C substitution.

In one embodiment, an ion channel having sigma pore dependent permeation suitable for use with the methods described herein will be a Cav1.3 protein comprising a H1124C substitution.

In one embodiment, an ion channel having sigma pore dependent permeation suitable for use with the methods described herein will be a Cav1.4 protein comprising a Y1098C substitution.

In one embodiment, an ion channel having sigma pore dependent permeation suitable for use with the methods described herein will be a Cav2.1 protein comprising a Y1486C substitution.

In one embodiment, an ion channel having sigma pore dependent permeation suitable for use with the methods described herein will be a Cav2.2 protein comprising a Y1388C substitution.

In one embodiment, an ion channel having sigma pore dependent permeation suitable for use with the methods described herein will be a Cav2.3 protein comprising a N1376C substitution.

In one embodiment, an ion channel having sigma pore dependent permeation suitable for use with the methods described herein will be a Cav3.1 protein comprising a G1221C substitution.

In one embodiment, an ion channel having sigma pore dependent permeation suitable for use with the methods described herein will be a Cav3.2 protein comprising a D1244C substitution.

In one embodiment, an ion channel having sigma pore dependent permeation suitable for use with the methods described herein will be a Cav3.3 protein comprising a K1068C substitution.

In one embodiment, an ion channel having sigma pore dependent permeation suitable for use with the methods described herein will be a Kv1.1 protein comprising a V368C substitution.

In one embodiment, an ion channel having sigma pore dependent permeation suitable for use with the methods described herein will be a Kv1.2 protein comprising a V370C substitution.

In one embodiment, an ion channel having sigma pore dependent permeation suitable for use with the methods described herein will be a Kv1.3 protein comprising a V440C substitution.

In one embodiment, an ion channel having sigma pore dependent permeation suitable for use with the methods described herein will be a Kv1.4 protein comprising a V520C substitution.

In one embodiment, an ion channel having sigma pore dependent permeation suitable for use with the methods described herein will be a Kv1.5 protein comprising a V476C substitution.

In one embodiment, an ion channel having sigma pore dependent permeation suitable for use with the methods described herein will be a Kv1.6 protein comprising a V418C substitution.

In one embodiment, an ion channel having sigma pore dependent permeation suitable for use with the methods described herein will be a Kv1.7 protein comprising a V354C substitution.

In one embodiment, an ion channel having sigma pore dependent permeation suitable for use with the methods described herein will be a Kv1.8 protein comprising a V417C substitution.

In one embodiment, an ion channel having sigma pore dependent permeation suitable for use with the methods described herein will be a Kv2.1 protein comprising a I373C substitution.

In one embodiment, an ion channel having sigma pore dependent permeation suitable for use with the methods described herein will be a Kv2.2 protein comprising a I377C substitution.

In one embodiment, an ion channel having sigma pore dependent permeation suitable for use with the methods described herein will be a Kv3.1 protein comprising a V396C substitution.

In one embodiment, an ion channel having sigma pore dependent permeation suitable for use with the methods described herein will be a Kv3.2 protein comprising a V433C substitution.

In one embodiment, an ion channel having sigma pore dependent permeation suitable for use with the methods described herein will be a Kv3.3 protein comprising a V499C substitution.

In one embodiment, an ion channel having sigma pore dependent permeation suitable for use with the methods described herein will be a Kv3.4 protein comprising a V432C substitution.

In one embodiment, an ion channel having sigma pore dependent permeation suitable for use with the methods described herein will be a Kv4.1 protein comprising a V368C substitution.

In one embodiment, an ion channel having sigma pore dependent permeation suitable for use with the methods described herein will be a Kv4.2 protein comprising a V366C substitution.

In one embodiment, an ion channel having sigma pore dependent permeation suitable for use with the methods described herein will be a Kv4.3 protein comprising a V363C substitution.

In one embodiment, an ion channel having sigma pore dependent permeation suitable for use with the methods described herein will be a Kv6.1 protein comprising a I420C substitution.

In one embodiment, an ion channel having sigma pore dependent permeation suitable for use with the methods described herein will be a Kv6.2 protein comprising a I365C substitution.

In one embodiment, an ion channel having sigma pore dependent permeation suitable for use with the methods described herein will be a Kv6.3 protein comprising a W365C substitution.

In one embodiment, an ion channel having sigma pore dependent permeation suitable for use with the methods described herein will be a Kv6.4 protein comprising a I414C substitution.

In one embodiment, an ion channel having sigma pore dependent permeation suitable for use with the methods described herein will be a Kv7.1 protein comprising a K427C substitution.

In one embodiment, an ion channel having sigma pore dependent permeation suitable for use with the methods described herein will be a Kv7.2 protein comprising a F496C substitution.

In one embodiment, an ion channel having sigma pore dependent permeation suitable for use with the methods described herein will be a Kv7.3 protein comprising a R500C substitution.

In one embodiment, an ion channel having sigma pore dependent permeation suitable for use with the methods described herein will be a Kv7.4 protein comprising a S444C substitution.

In one embodiment, an ion channel having sigma pore dependent permeation suitable for use with the methods described herein will be a Kv7.5 protein comprising a Y500C substitution.

In one embodiment, an ion channel having sigma pore dependent permeation suitable for use with the methods described herein will be a Kv8.1 protein comprising a T388C substitution.

In one embodiment, an ion channel having sigma pore dependent permeation suitable for use with the methods described herein will be a Kv8.2 protein comprising a V453C substitution.

In one embodiment, an ion channel having sigma pore dependent permeation suitable for use with the methods described herein will be a Kv9.1 protein comprising a V417C substitution.

In one embodiment, an ion channel having sigma pore dependent permeation suitable for use with the methods described herein will be a Kv9.2 protein comprising a V370C substitution.

In one embodiment, an ion channel having sigma pore dependent permeation suitable for use with the methods described herein will be a Kv9.3 protein comprising a V370C substitution.

In one embodiment, an ion channel having sigma pore dependent permeation suitable for use with the methods described herein will be a Kv10.1 protein comprising a V519C substitution.

In one embodiment, an ion channel having sigma pore dependent permeation suitable for use with the methods described herein will be a Kv10.2 protein comprising a V488C substitution.

In one embodiment, an ion channel having sigma pore dependent permeation suitable for use with the methods described herein will be a Kv12.1 protein comprising a L490C substitution.

In one embodiment, an ion channel having sigma pore dependent permeation suitable for use with the methods described herein will be a Kv12.2 protein comprising a L521C substitution.

In one embodiment, an ion channel having sigma pore dependent permeation suitable for use with the methods described herein will be a Kv12.3 protein comprising a L495C substitution.

In one embodiment, an ion channel having sigma pore dependent permeation suitable for use with the methods described herein will be a HCN1 protein comprising a V519C substitution.

In one embodiment, an ion channel having sigma pore dependent permeation suitable for use with the methods described herein will be a HCN2 protein comprising a V588C substitution.

In one embodiment, an ion channel having sigma pore dependent permeation suitable for use with the methods described herein will be a HCN3 protein comprising a L472C substitution.

In one embodiment, an ion channel having sigma pore dependent permeation suitable for use with the methods described herein will be a HCN4 protein comprising a V639C substitution.

In one embodiment, an ion channel having sigma pore dependent permeation suitable for use with the methods described herein will be a CatSper1 protein comprising a T406C substitution.

In one embodiment, an ion channel having sigma pore dependent permeation suitable for use with the methods described herein will be a CatSper2 protein comprising a Y414C substitution.

In one embodiment, an ion channel having sigma pore dependent permeation suitable for use with the methods described herein will be a CatSper3 protein comprising a A315C substitution.

In one embodiment, an ion channel having sigma pore dependent permeation suitable for use with the methods described herein will be a CatSper4 protein comprising a M314C substitution.

In one embodiment, an ion channel having sigma pore dependent permeation suitable for use with the methods described herein will be a Hv1 protein comprising a L231C substitution.

In one embodiment, an ion channel having sigma pore dependent permeation suitable for use with the methods described herein will be a KCa1.1 protein comprising a M748C substitution.

In one embodiment, an ion channel having sigma pore dependent permeation suitable for use with the methods described herein will be a KCa4.1 protein comprising a K751C substitution.

In one embodiment, an ion channel having sigma pore dependent permeation suitable for use with the methods described herein will be a KCa4.2 protein comprising a K669C substitution.

In one embodiment, an ion channel having sigma pore dependent permeation suitable for use with the methods described herein will be a TPC1 protein comprising a R682C substitution.

The S2 segment of the Shaker channel comprises a well-conserved F290 aromatic residue. This residues faces the intracellular side of the hydrophobic plug and forms part of a hydrogen bonding network with conserved basic residues in S2 and S3 in certain VGICs (Lacroix and Benzanilla, Proc Natl Acad Sci USA. 2011 Apr. 19; 108(16):6444-9). The F290 residue in the Shaker protein controls the gating charge transition energy barrier. Substitution of the phenylalanine at position 290 of the Shaker protein with a less hydrophobic residue produces faster deactivation kinetics relative to activation, wherein substitution with a more hydrophobic residue results slower deactivation kinetics relative to activation (Tao et al., Science. 2010 Apr. 2; 328(5974):67-73). As used herein, the hydrophobicity of an amino acid in a VGIC is measured according to the hydrophobicity scale set forth in Wimley and White Nat Struct Biol 1996, 3:842-848, wherein amino acid hydrophobicity, from least hydrophobic to most hydrophobic is E→D→K→R→H→Q→P→N→H→A→T→S→V→G→M→C→I→L→Y→F→W.

In one embodiment, an ion channel having an S2 gating charge transport mutation suitable for use with the methods described herein will be a Shaker protein comprising a substitution of the phenylalanine at position 290 with an amino acid that is less hydrophobic than phenylalanine wherein the substituted protein has faster deactivation kinetics relative to activation or a substitution of the phenylalanine at position 290 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Cav 3.3 protein comprising a substitution of the tyrosine at position 840 with an amino acid that is less hydrophobic than tyrosine wherein the substituted protein has faster deactivation kinetics relative to activation or a substitution of the tyrosine at position 840 with an amino acid that is more hydrophobic than tyrosine wherein the substituted protein has slower deactivation kinetics relative to activation.

In one embodiment, an ion channel having an S2 gating charge transport mutation suitable for use with the methods described herein will be a Kv1.1. protein comprising a substitution of the phenylalanine at position 232 with an amino acid that is less hydrophobic than phenylalanine wherein the substituted protein has faster deactivation kinetics relative to activation or a substitution of the phenylalanine at position 232 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv1.2 protein comprising a substitution of the phenylalanine at position 233 with an amino acid that is less hydrophobic than phenylalanine wherein the substituted protein has faster deactivation kinetics relative to activation or a substitution of the phenylalanine at position 233 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv1.3 protein comprising a substitution of the phenylalanine at position 308 with an amino acid that is less hydrophobic than phenylalanine wherein the substituted protein has faster deactivation kinetics relative to activation or a substitution of the phenylalanine at position 308 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv1.4 protein comprising a substitution of the phenylalanine at position 382 with an amino acid that is less hydrophobic than phenylalanine wherein the substituted protein has faster deactivation kinetics relative to activation or a substitution of the phenylalanine at position 382 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv1.5 protein comprising a substitution of the phenylalanine at position 335 with an amino acid that is less hydrophobic than tyrosine wherein the substituted protein has faster deactivation kinetics relative to activation or a substitution of the phenylalanine at position 335 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv1.6 protein comprising a substitution of the phenylalanine at position 274 with an amino acid that is less hydrophobic than phenylalanine wherein the substituted protein has faster deactivation kinetics relative to activation or a substitution of the phenylalanine at position 274 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv1.7 protein comprising a substitution of the phenylalanine at position 220 with an amino acid that is less hydrophobic than phenylalanine wherein the substituted protein has faster deactivation kinetics relative to activation or a substitution of the phenylalanine at position 220 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv1.8 protein comprising a substitution of the phenylalanine at position 282 with an amino acid that is less hydrophobic than phenylalanine wherein the substituted protein has faster deactivation kinetics relative to activation or a substitution of the phenylalanine at position 282 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv2.1 protein comprising a substitution of the phenylalanine at position 240 with an amino acid that is less hydrophobic than phenylalanine wherein the substituted protein has faster deactivation kinetics relative to activation or a substitution of the phenylalanine at position 240 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv2.2 protein comprising a substitution of the phenylalanine at position 244 with an amino acid that is less hydrophobic than phenylalanine wherein the substituted protein has faster deactivation kinetics relative to activation or a substitution of the phenylalanine at position 244 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv3.1 protein comprising a substitution of the phenylalanine at position 256 with an amino acid that is less hydrophobic than phenylalanine wherein the substituted protein has faster deactivation kinetics relative to activation or a substitution of the phenylalanine at position 256 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv3.2 protein comprising a substitution of the phenylalanine at position 293 with an amino acid that is less hydrophobic than phenylalanine wherein the substituted protein has faster deactivation kinetics relative to activation or a substitution of the phenylalanine at position 293 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv3.3 protein comprising a substitution of the tyrosine at position 359 with an amino acid that is less hydrophobic than tyrosine wherein the substituted protein has faster deactivation kinetics relative to activation or a substitution of the tyrosine at position 359 with an amino acid that is more hydrophobic than tyrosine wherein the substituted protein has slower deactivation kinetics relative to activation.

In one embodiment, an ion channel having an S2 gating charge transport mutation suitable for use with the methods described herein will be a Kv3.4 protein comprising a substitution of the phenylalanine at position 292 with an amino acid that is less hydrophobic than phenylalanine wherein the substituted protein has faster deactivation kinetics relative to activation or a substitution of the phenylalanine at position 292 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv4.1 protein comprising a substitution of the phenylalanine at position 242 with an amino acid that is less hydrophobic than phenylalanine wherein the substituted protein has faster deactivation kinetics relative to activation or a substitution of the phenylalanine at position 242 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv4.2 protein comprising a substitution of the phenylalanine at position 240 with an amino acid that is less hydrophobic than phenylalanine wherein the substituted protein has faster deactivation kinetics relative to activation or a substitution of the phenylalanine at position 240 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv4.3 protein comprising a substitution of the phenylalanine at position 237 with an amino acid that is less hydrophobic than phenylalanine wherein the substituted protein has faster deactivation kinetics relative to activation or a substitution of the phenylalanine at position 237 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv5.1 protein comprising a substitution of the phenylalanine at position 233 with an amino acid that is less hydrophobic than phenylalanine wherein the substituted protein has faster deactivation kinetics relative to activation or a substitution of the phenylalanine at position 233 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv6.1 protein comprising a substitution of the phenylalanine at position 279 with an amino acid that is less hydrophobic than phenylalanine wherein the substituted protein has faster deactivation kinetics relative to activation or a substitution of the phenylalanine at position 279 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv6.2 protein comprising a substitution of the phenylalanine at position 229 with an amino acid that is less hydrophobic than phenylalanine wherein the substituted protein has faster deactivation kinetics relative to activation or a substitution of the phenylalanine at position 229 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv6.3 protein comprising a substitution of the phenylalanine at position 232 with an amino acid that is less hydrophobic than phenylalanine wherein the substituted protein has faster deactivation kinetics relative to activation or a substitution of the phenylalanine at position 232 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv6.4 protein comprising a substitution of the phenylalanine at position 273 with an amino acid that is less hydrophobic than phenylalanine wherein the substituted protein has faster deactivation kinetics relative to activation or a substitution of the phenylalanine at position 273 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv8.1 protein comprising a substitution of the phenylalanine at position 253 with an amino acid that is less hydrophobic than phenylalanine wherein the substituted protein has faster deactivation kinetics relative to activation or a substitution of the phenylalanine at position 253 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv9.1 protein comprising a substitution of the phenylalanine at position 283 with an amino acid that is less hydrophobic than phenylalanine wherein the substituted protein has faster deactivation kinetics relative to activation or a substitution of the phenylalanine at position 283 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv9.2 protein comprising a substitution of the phenylalanine at position 246 with an amino acid that is less hydrophobic than phenylalanine wherein the substituted protein has faster deactivation kinetics relative to activation or a substitution of the phenylalanine at position 246 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv9.3 protein comprising a substitution of the phenylalanine at position 246 with an amino acid that is less hydrophobic than phenylalanine wherein the substituted protein has faster deactivation kinetics relative to activation or a substitution of the phenylalanine at position 246 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv10.1 protein comprising a substitution of the tyrosine at position 398 with an amino acid that is less hydrophobic than tyrosine wherein the substituted protein has faster deactivation kinetics relative to activation or a substitution of the tyrosine at position 398 with an amino acid that is more hydrophobic than tyrosine wherein the substituted protein has slower deactivation kinetics relative to activation.

In one embodiment, an ion channel having an S2 gating charge transport mutation suitable for use with the methods described herein will be a Kv10.2 protein comprising a substitution of the tyrosine at position 268 with an amino acid that is less hydrophobic than tyrosine wherein the substituted protein has faster deactivation kinetics relative to activation or a substitution of the tyrosine at position 268 with an amino acid that is more hydrophobic than tyrosine wherein the substituted protein has slower deactivation kinetics relative to activation.

In one embodiment, an ion channel having an S2 gating charge transport mutation suitable for use with the methods described herein will be a Kv11.1 protein comprising a substitution of the tyrosine at position 569 with an amino acid that is less hydrophobic than tyrosine wherein the substituted protein has faster deactivation kinetics relative to activation or a substitution of the tyrosine at position 569 with an amino acid that is more hydrophobic than tyrosine wherein the substituted protein has slower deactivation kinetics relative to activation.

In one embodiment, an ion channel having an S2 gating charge transport mutation suitable for use with the methods described herein will be a Kv11.2 protein comprising a substitution of the tyrosine at position 420 with an amino acid that is less hydrophobic than tyrosine wherein the substituted protein has faster deactivation kinetics relative to activation or a substitution of the tyrosine at position 420 with an amino acid that is more hydrophobic than tyrosine wherein the substituted protein has slower deactivation kinetics relative to activation.

In one embodiment, an ion channel having an S2 gating charge transport mutation suitable for use with the methods described herein will be a Kv11.3 protein comprising a substitution of the tyrosine at position 571 with an amino acid that is less hydrophobic than tyrosine wherein the substituted protein has faster deactivation kinetics relative to activation or a substitution of the tyrosine at position 571 with an amino acid that is more hydrophobic than tyrosine wherein the substituted protein has slower deactivation kinetics relative to activation.

In one embodiment, an ion channel having an S2 gating charge transport mutation suitable for use with the methods described herein will be a Kv12.1 protein comprising a substitution of the tyrosine at position 375 with an amino acid that is less hydrophobic than tyrosine wherein the substituted protein has faster deactivation kinetics relative to activation or a substitution of the tyrosine at position 375 with an amino acid that is more hydrophobic than tyrosine wherein the substituted protein has slower deactivation kinetics relative to activation.

In one embodiment, an ion channel having an S2 gating charge transport mutation suitable for use with the methods described herein will be a Kv12.2 protein comprising a substitution of the phenylalanine at position 379 with an amino acid that is less hydrophobic than phenylalanine wherein the substituted protein has faster deactivation kinetics relative to activation or a substitution of the phenylalanine at position 379 with an amino acid that is more hydrophobic than phenylalanine wherein the substituted protein has slower deactivation kinetics relative to activation.

In one embodiment, an ion channel having an S2 gating charge transport mutation suitable for use with the methods described herein will be a Kv12.3 protein comprising a substitution of the tyrosine at position 381 with an amino acid that is less hydrophobic than tyrosine wherein the substituted protein has faster deactivation kinetics relative to activation or a substitution of the tyrosine at position 381 with an amino acid that is more hydrophobic than tyrosine wherein the substituted protein has slower deactivation kinetics relative to activation.

In one embodiment, an ion channel having an S2 gating charge transport mutation suitable for use with the methods described herein will be a Catsper3 protein comprising a substitution of the phenylalanine at position 196 with an amino acid that is less hydrophobic than phenylalanine wherein the substituted protein has faster deactivation kinetics relative to activation or a substitution of the phenylalanine at position 196 with an amino acid that is more hydrophobic than phenylalanine wherein the substituted protein has slower deactivation kinetics relative to activation.

Ion Channel Modulating Agents

The methods described herein can also be performed with the use of small molecule agents that block or modulate the function of ion channels. In certain embodiments, the methods described herein can be performed by contacting an ion channel with a small molecule compound in the presence or absence of a ion channel modulating agent.

Several such ion channel modulating agents are known in the art and include, but are not limited to turret blocking agents, main-pore blocking agents, gating-modifying agents, cysteine-tethered reagent agents, or voltage sensing domain toxins, including, but not limited to those described in Triggle et al., Voltage-Gated Ion Channels as Drug Targets. Feb. 28, 2006 20:55, and Dilly et al., Chembiochem. 2011 Aug. 16; 12(12):1808-12. Exemplary ion channel modulating agents suitable for use with methods described herein include, but are not limited to classical Kv channel inhibitors (e.g. 4-aminopyridine and tetramethylammonium), non specific compounds (e.g. calcium activated potassium channel blockers quinine and ceteidil), phenothiazine antipsychotics (e.g. chloropromazine and trifluoroperazine), classical calcium channel inhibitors (e.g. verapamil, diltiazem, nifedipine and nitrendipine) and beta blockers (e.g. propranolol). Other ion channel modulating agents that can be used in connection with the methods described herein include, but are not limited to, iminodihydroquinolines WIN173173 and CP339818 (Nguyen et al., 1996), the benzhydryl piperidine UK-78,282 (Hanson et al.

1999), correolide (Felix et al., 1999), cyclohexyl-substituted benzamide PAC (U.S. Pat. No. 6,194,458, WO0025774), sulfamidebenzamidoindane (U.S. Pat. No. 6,083,986), Khellinone (Baell et al., 2004), dichloropenylpyrazolopyrimidine (WO-00140231) psoralens (Wulff et al., 1998, Vennekamp et al., 2004, Schmitz et al., 2005) and isoindolines (WO 2008/038051). Table 2 provides an exemplary list of ion channel modulating agents capable of modulating Kv1.3 ion conductance as well as the IC50 for each molecule or metal.

TABLE 2

Exemplary ion channel modulating agents capable of modulating Kv1.3 ion conductance

| Ion Channel Modulating Agents | IC50 | Ion Channel Modulating Agents | IC50 |
|---|---|---|---|
| PAP-1 | 2 nM | H37 | 10 μM |
| Psora-4 | 3 nM | Hg2+ | 10 μM |
| Tetraphenyl-porphyrin 3 | 20 nM | Kokusagenine | 10 μM |
| Correolide C18-analog 43 | 30 nM | Qunine | 14 μM |
| trans-N-Propyl-carbamoyloxy-PAC | 50 nM | Cicutotoxin | 18 μM |
| Correolide | 90 nM | Trifluoperazine | 20 μM |
| Sulfamibenzamido-indane | 100 nM | Forskolin | 20 μM |
| CP-339818 | 150 nM | Capsaisin | 26 μM |
| WIN-17317-3 | 200 nM | Diltiazem | 27 μM |
| UK-78282 | 200 nM | Progesterone | 30 μM |
| PAC | 270 nM | Luteolin | 30 μM |
| Khellinone dimer 2 | 280 nM | La3+ | 50 μM |
| Khellinone chalcone 16 | 400 nM | Flecainide | 60 μM |
| 6-(2-5-Dimethyl-phenyl)psoralem | 700 nM | K22-Y23-R11 ShK mimetic | 95 μM |
| H-98 | 1.7 μM | S-MOP | 101 μM |
| Reviniferatoxin | 3 μM | H2O2 | 100 μM |
| Phenyl-stillbene A | 2.9 μM | 4-AP | 195 μM |
| Nifedipene | 5 μM | Zn2+, Co2+ | 200 μM |
| Nitrendipene | 5 μM | Melatonin | 1.5 mM |
| Ibu-8 | 5 μM | Ba2+, Cd2+ | 2 mM |
| Phenycylidine | 5 μM | TEA | 10 mM |
| Fluoxetine | 6 μM | Mn2+ | 20 mM |
| Varapamil | 6 μM | | |

Other ion channel modulating agents are known in the art and include, but are not limited to, lanthanum (III) chloride heptahydrate, which can be dissolved to generate $La^{3+}$ ions. In one embodiment, $La^{3+}$ ions can be applied by a fast perfusion technique. In one embodiment, $La^{3+}$ ions can block omega currents of an ion channel or ion channel mutant (e.g. Shaker channel, Kv2.1 channel). In one embodiment, $La^{3+}$ ions do not block omega currents of an ion channel or ion channel mutant (e.g. Shaker channel, Kv2.1 channel).

Other ion channel modulating agents are known in the art and also include, but are not limited to, 2-guanidinium-benzimidazole (2GBI), 5-[(cyclopentylcarbonyl)amino]-2-(dimethylamino)-N-[(1R)-1-phenylethyl]-benzamide (B1), and 3-methoxy-β-methyl-N-[2-(4-thiazolyl)-1H-benzimidazol-6-yl]-benzenepropanamide (RY785). In one embodiment, 2GBI, B1, or RY785 is used at a concentraton above the IC50 for inhibition of the outward current through the alpha pore. In one embodiment, 2GBI is used at a concentraton of 10 mM. In one embodiment, B1 is used at a concentraton of 10 μM. In one embodiment, RY785 is used at a concentraton of 10 μM. In one embodiment, 2GBI, B1, or RY785 ions block omega currents of an ion channel or ion channel mutant (e.g. Shaker channel, Kv2.1 channel). In one embodiment, 2GBI, B1, or RY785 ions do not block omega currents of an ion channel or ion channel mutant (e.g. Shaker channel, Kv2.1 channel).

Lanthanum (III) chloride heptahydrate, which can be dissolved to generate $La^{3+}$ ions. In one embodiment, $La^{3+}$ ions can be applied by a fast perfusion technique. In one embodiment, $La^{3+}$ ions can block omega currents of an ion channel or ion channel mutant (e.g. Shaker channel, Kv2.1 channel). In one embodiment, $La^{3+}$ ions do not block omega currents of an ion channel or ion channel mutant (e.g. Shaker channel, Kv2.1 channel).

Further ion channel modulating agents are known in the art and include, but are not limited to, cysteine-reactive reagents, including, but not limited to MTSEA, MTSES, and MTSET. In one embodiment, a cysteine-reactive reagent (e.g. MTSEA, MTSES, MTSET) can be applied by a fast perfusion technique. In one embodiment, a cysteine-reactive reagent (e.g. MTSEA, MTSES, MTSET) can block inward gating pore leak currents of an ion channel or ion channel mutant (e.g. Shaker channel, Kv2.1 channel). In one embodiment, a cysteine-reactive reagent (e.g. MTSEA, MTSES, MTSET) do not block inward gating pore leak currents of an ion channel or ion channel mutant (e.g. Shaker channel, Kv2.1 channel).

In certain embodiments, the methods described herein relate to the monitoring the activity of a mutated ion channel protein, wherein the mutation causes the ion channel to exhibit an ion leak through either one or more omega or sigma pores when the channel is in a closed or inactivated state. In certain embodiments, the ion channel described herein can comprise a mutation that renders the ion channel incapable, or partially incapable of adopting a closed or inactivated configuration such that ions remain capable of passing through an alpha pore of the ion channel when the ion channel is subjected to a condition that will cause the channel to adopt either a closed or inactivated state. Thus, in embodiments, where an ion channel comprising a mutation that renders the channel incapable of blocking ion transit through the alpha pore of the on channel under closing or inactivating conditions, the methods described herein can further comprise a step of contacting the ion channel in a membrane with one or more channel blocking toxins capable of blocking the alpha pore of the ion channel. Accordingly, channel blocking toxins can be used in connection with the methods described herein to eliminate a contaminating current in an ion channel of interest. In certain embodiments, the contaminating current will be due to the activity of a mutant channel under study. In certain embodiments, the contaminating current will be from one or more ion channels endogenously expressed in a membrane of interest.

Many channel blocking toxins are known to exhibit specificity to a particular type or class of ion channels. Further, the specificity of the particular channel blocking toxin can be concentration dependent. For example, it is known that tetrodotoxin (TTX) at a concentration of 100 nM can be used to block the activity TTX sensitive VGSCs, but not affect the activity of TTX insensitive VGSCs.

A number of channel blocking toxins are known in the art. For example, many peptides that are naturally occurring in scorpions, snakes and other marine organisms are known to be potent blockers of ion channels.

Charybdotoxin, originally isolated in the venom of the *Leiurus quinquestriatus hebraeus* scorpion, is on example of a channel blocking toxin suitable for use with the methods described herein.

Other channel blocking toxins suitable for use for blocking the activity of an ion channel include, but are not limited to, simple pore blockers as well as gating modifiers. Without wishing to be bound by theory, pore blockers exhibit their effects on ion channel function by physically occluding the entry of ions into the transmembrane pore, whereas gating modifiers allosterically inhibit structural rearrangements that are involved in channel activation. Pore blockers generally function by binding to amino acid residues in the pore turret (as well as residues located close the pore turret) of voltage-gated ion channels (MacKinnon and Miller, 1989; MacKinnon et al., 1990; Gross et al., 1994; Gross and MacKinnon, 1996). Conversely, gating modifiers generally bind to conserved residues and structures on the extracellular face of the voltage sensor. In the case of VGPCs and VGCCs, gating modifiers generally bind to the extracellular end of the S3 helix (Swartz and MacKinnon, 1997; Bourinet et al., 1999; Winterfield and Swartz, 2000). Without wishing to be bound by theory, when bound by a gating modifier, the ion channel will have a compromised ability to undergo structural rearrangements required for activation of the channel and will accordingly remain stability in an inactivated or a closed state.

Examples of pore blockers suitable for use with the methods described herein include, but are not limited to, agitoxin, charybdotoxin, and ω-conotoxin-GVI MacKinnon et al., 1990; Ellinor et al., 1994; Garcia et al., 1994; Feng et al., 2001). Examples of gating modifiers suitable for use with the methods described herein include, but are not limited to hanatoxin, grammotoxin, and ω-agatoxin-IVA (Mintz et al., 1992; Lampe et al., 1993; Swartz and MacKinnon, 1995).

Other toxins include Guangxitoxin (GxTx-1E), a neurotoxin isolated from *Plesiophrictus guangxiensis* venom. In one embodiment, GxTx-1E is used at a concentraton above the IC50 for inhibition of the outward current through the alpha pore. In one embodiment, GxTx-1E is used at a concentraton of 100 nM. In one embodiment, GxTx-1E can open a channel omega pore of an ion channel or ion channel mutant (e.g. Shaker channel, Kv2.1 channel).

In certain embodiments, the methods described herein can comprise a step of contacting an ion channel to be monitored with the sea anemone *stichodactyla helianthus* toxin (Shk). Shk, and Shk derivatives (e.g. Shk-Dap$^{22}$) are potent Kv1.3 blockers that exhibit picomolar activity (Pennington et al, 1996; U.S. Pat. No. 6,077,680). Table 3 provides a list of channel blockers along with known IC50 values for Kv1.3 for a number of ion channel modulating agents.

TABLE 3

List of ion channel modulating agents along with known IC50 values

| Ion channel modulating agents | IC50 Values of Kv1.3 ion channel modulating agent |
|---|---|
| OSK1-Lys16Asp20 | 3 pM |
| *Stichodactyla helianthus* toxin (ShK) | 0.9 pM to 110 pm |
| *Heterometrus spinnifer* toxin 1 (HsTX1) | 12 pM |
| *Orthochirus scrobiculosus* toxin (OSK1) | 14 pM |
| Shk-F6CA | 48 pM |
| *Pandinus imperator* toxin 2 (Pi2) | 50 pM |
| Shk-Dap22 | 52 pM |
| ShK(L5) | 69 pM |
| Hongotoxin (HgTX1) | 86 pM |
| Margatoxin (MgTX) | 11 pM |
| Agitotoxin-2 (AgTX2) | 4 pM |
| *Pandinus imperator* toxin 3 (Pi3) | 500 pM |
| Kaliolotoxin (KTX) | 650 pM |
| Anuroctoxin | 730 pM |
| Noxiustoxin (NTX) | 1 nM |
| Charybdotoxin (ChTX) | 0.19 nM |
| Tityustoxin-Kalpha (TsTX-Kalpha) | 4 nM |
| *Pandinus imperator* toxin 1 (Pi1) | 11 nM |
| Kbot1 | 15 nM |
| *Bunodosema granulifera* toxin (BgK) | 39 nM |
| Maurotoxin (MTX) | 150 nM |
| alpha-Dendrotoxin (DTX) | 250 nM |
| *Parabuthus* toxin 3 (PbTX3) | 492 nM |
| *Parabuthus* toxin 1 (PbTX1) | 800 nM |
| ViTX | 2 µM |
| kappa-Hefutoxin 1 (kappa-HfTX1) | 150 µM |
| *Opisthacanus madagascariensis* toxin (OmTX3) | 400 µM |

One of skill in the art will appreciate that because ion channels of the various families and subfamilies described herein share functional, sequence and structural similarity, the channel blockers shown in Table 3 can also exhibit inhibitory effects on other ion channels in addition to Kv1.3. For example, Table 4 provide a list of selected channel blockers and their 1050 with One of skill in the art will readily be able to determine the 1050 of a particular channel blocker and an ion channel using methods known in the art.

TABLE 4

| | IC50 values for various toxins | | | | |
|---|---|---|---|---|---|
| Toxin | Kv1.1 | Kv1.2 | Kv1.3 | Kv1.5 | KCa3.1 Others |
| Margatoxin (MgTX) | 144 pM to 10 nM | 520 pM to 675 pM | 110 pM to 230 pM | No effect | No effect |
| Kaliolotoxin (KTX) | 41 nM | >1 µM | 650 pM | | |
| Hongotoxin (HgTX1) | 31 pM | 170 pM | 86 pM | | No effect |
| Noxiustoxin (NTX) | >25 nM | 2 nM | 1 nM | >25 nM | No effect |
| *Heterometrus spinnifer* toxin 1 (HsTX1) | 7 nM | No effect | 12 pM | | 625 nM |
| Maurotoxin (MTX) | No effect | 110 pM | 150 nM | | 1 nM |
| *Orthochirus scrobiculosus* toxin (OSK1) | 600 pM | 5.4 nM | 14 pM | >1 µM | 225 nM |

TABLE 4-continued

IC50 values for various toxins

| Toxin | Kv1.1 | Kv1.2 | Kv1.3 | Kv1.5 | KCa3.1 | Others |
|---|---|---|---|---|---|---|
| OSK1-Lys16Asp20 | 400 pM | 2.96 nM | 3 pM | >1 μM | 228 nM | |
| Pandinus imperator toxin 2 (Pi2) | | | 50 pM | | | |
| Anuroctoxin | | 5 nM | 730 pM | | No effect | |
| alpha-Dendrotoxin (DTX) | 1.1 nM to 20 μM | 17 nM | 200 nM | >1 μM | | |
| Bunodosema granulifera toxin (BgK) | 6 nM | 15 nM to 25 nM | 39 pM to 10 nM | | 172 nM | |
| ViTX | 2 μM | No effect | 2 μM | | | |
| Correolide | 21 nM to 430 nM | 10 nM to 700 nM | 90 nM to 110 nM | 7 nM to 1.1 μM | | Kv1.6 19 nM to 450 nM Kv1.4 10 nM |
| PAC | 200 nM to 400 nM | 200 nM to 400 nM | 149 nM | 200 nM to 400 nM | | Kv1.6 200 nM to 400 nM |
| Psora-4 | 62 nM | 49 nM | 3 nM | 8 nM | >5 μM | Kv1.4 202 nM Kv1.7 100 nM |
| PAP-1 | 65 nM | 250 nM | 2 nM | 45 nM | 10 μM | Kv1.6 62 nM Kv1.7 98 nM |
| LiK-78282 | 22 μM | 2.9 μM | 280 nM | 70 nM | >30 μM | Kv1.4 170 nM Kv1.6 31 μM Kv3.2 127 μM |
| CP-339818 | 62 μM | 14 μM | 230 nM | 19 μM | >500 μM | Kv1.4 300 nM Nav 10 nM |
| Chalcone-16 | 1.2 μM | >50 μM | 400 nM | 5.1 μM | >100 μM | Kv1.7 10 μM |
| Khellinone dimer-2 | 3.1 μM | 2 μM | 280 nM | 1.1 μM | >100 μM | |

Because different ion channels exhibit differential sensitivity to ion channel toxins, one of skill in the art will readily be capable of modifying toxin insensitive ion channels by introducing one of more amino acid substitutions into the amino acid sequence of the insensitive ion channel to render the ion channel sensitive to a toxin. Without wishing to be bound by theory, sensitivity of an ion channel to a toxin can depend on the sequence of the S5-S6 linker of the ion channel. As such, one of skill in the art will be capable of modifying the S5-S6 region of an ion channel to render an ion channel sensitive to a toxin by introducing one or more mutations that mimic the S5-S6 sequence of a toxin sensitive channel. For example, it is known that the VGPCs KV 1.3 and Kv2.1 differ significantly in their sensitivity to the scorpion toxin AgTx2 (Garcia et al, Biochemistry 33, 6834-3839 (1994)). While Kv1.3 is sensitive to various AgTx2 toxin isoforms, Kv2.1 is insensitive to AgTx2.

Table 5 provides IC50 values between various pore blocking agents and gating modifier toxins and Kv1.1, Kv1.2, Kv1.3, Kv1.5, Kv2.1, Kv2.2 and Kv2.2 having T359S, K360G, A366D, S367A, I383M, Y384T, and K386V mutations.

TABLE 5

IC50 values between various pore blocking agents and toxins

| | Pore Blocking Agent | | | | Gating Modifier Toxins | |
|---|---|---|---|---|---|---|
| Channel | AgTx-1 | Agtx-2 | ChTx | ShK | HaTx | GxTx-IE |
| Shaker | 0.16 nM | 0.64 nM | 227 nM | — | Weak | — |
| Kv1.1 | 136 nM | 0.044 nM | 1500 nM | 0.025 nM to 0.118 nM | >500 nM | — |
| Kv1.2 | — | No/little effect | 14 nM | >1000 nM | >2000 nM | No effect |
| Kv1.3 | 1.7 nM | 0.004 nM | 0.19 nM | 0.0009 nM to 0.011 nM | >500 nM | No effect |
| Kv2.1 | >2000 nM | >2000 nM | >2000 nM | No effect | 107 nM | 2 nM |
| Kv2.2 | — | — | — | — | — | 2.6 nM |
| Kv2.1 T359S K360G A366D S367A I383M Y384T K386V | — | 0.007 nM | — | — | 102 nM | ~2.0 nM |

One of skill in the art will appreciate that because replacement of the S5-S6 region in Kv2.1 with the S5-S6 region of Kv1.3 will yield a modified Kv2.1 protein that is sensitive to AgTx2 (Gross et al., Neuron, V. 13, 961-966 (1994). Thus in certain embodiments, the methods described herein can performed with an ion channel protein modified to render the ion channel sensitive to a scorpion toxin (e.g. AgTx2).

In one embodiment, an ion channel modified to render the ion channel sensitive to a scorpion toxin (e.g. AgTx2) suitable for use with the methods described herein is a Shaker protein comprising a modification wherein the region comprising amino acid residues 424 to 451 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a F425G substitution, a T449H substitution or any combination thereof.

In one embodiment, an ion channel modified to render the ion channel sensitive to a scorpion toxin (e.g. AgTx2) suitable for use with the methods described herein is a Nav1.1 protein comprising a modification wherein the region comprising amino acid residues 1422 to 1490 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a Y1422S substitution, a A1429G substitution, a M1435D substitution, a D1436A substitution, a K1490V substitution or any combination thereof.

In one embodiment, an ion channel modified to render the ion channel sensitive to a scorpion toxin (e.g. AgTx2) suitable for use with the methods described herein is a Nav1.2 protein comprising a modification wherein the region comprising amino acid residues 1422 to 1480 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a Y1422S substitution, a A1419G substitution, a M1435D substitution, a D1426A substitution, a Y1450H substitution, a K1480V substitution or any combination thereof.

In one embodiment, an ion channel modified to render the ion channel sensitive to a scorpion toxin (e.g. AgTx2) suitable for use with the methods described herein is a Nav1.3 protein comprising a modification wherein the region comprising amino acid residues 1407 to 1475 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a Y1407S substitution, a A1414G substitution, a M1420D substitution, a D1421A substitution, a Y1445H substitution, a K1475V substitution or any combination thereof.

In one embodiment, an ion channel modified to render the ion channel sensitive to a scorpion toxin (e.g. AgTx2) suitable for use with the methods described herein is a Nav1.4 protein comprising a modification wherein the region comprising amino acid residues 1234 to 1302 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a Y1234S substitution, a A1241G substitution, a M1247D substitution, a D1248A substitution, a Y1272H substitution, a K1302V substitution or any combination thereof.

In one embodiment, an ion channel modified to render the ion channel sensitive to a scorpion toxin (e.g. AgTx2) suitable for use with the methods described herein is a Nav1.5 protein comprising a modification wherein the region comprising amino acid residues 1409 to 1477 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a Y1409S substitution, a A1416G substitution, a M1422D substitution, a D1423A substitution, a Y1447H substitution, a K1477V substitution or any combination thereof.

In one embodiment, an ion channel modified to render the ion channel sensitive to a scorpion toxin (e.g. AgTx2) suitable for use with the methods described herein is a Nav1.6 protein comprising a modification wherein the region comprising amino acid residues 1403 to 1471 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a Y1403S substitution, a A1410G substitution, a M1416D substitution, a D1417A substitution, a Y1441H substitution, a K1471V substitution or any combination thereof.

In one embodiment, an ion channel modified to render the ion channel sensitive to a scorpion toxin (e.g. AgTx2) suitable for use with the methods described herein is a Nav1.7 protein comprising a modification wherein the region comprising amino acid residues 1385 to 1453 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a Y1385S substitution, a A1392G substitution, a T1398D substitution, a I1399A substitution, a Y1423H substitution, a K1453V substitution or any combination thereof.

In one embodiment, an ion channel modified to render the ion channel sensitive to a scorpion toxin (e.g. AgTx2) suitable for use with the methods described herein is a Nav1.8 protein comprising a modification wherein the region comprising amino acid residues 1357 to 1435 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a Y1357S substitution, a A1364G substitution, a M1370D substitution, a D1371A substitution, a Y1395H substitution, a K1435V substitution or any combination thereof.

In one embodiment, an ion channel modified to render the ion channel sensitive to a scorpion toxin (e.g. AgTx2) suitable for use with the methods described herein is a Nav1.9 protein comprising a modification wherein the region comprising amino acid residues 1247 to 1335 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a Y1247S substitution, a A1254G substitution, a M1260D substitution, a D1261A substitution, a G1284M substitution, a Y1285H substitution, a Q1335V substitution or any combination thereof.

In one embodiment, an ion channel modified to render the ion channel sensitive to a scorpion toxin (e.g. AgTx2) suitable for use with the methods described herein is a Cav1.1 protein comprising a modification wherein the region comprising amino acid residues 1005 to 1112 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a M1005S substitution, a L1019G substitution, a S1026A substitution, a C1088M substitution, a V1089H substitution, a Q1112V substitution or any combination thereof.

In one embodiment, an ion channel modified to render the ion channel sensitive to a scorpion toxin (e.g. AgTx2) suitable for use with the methods described herein is a Cav1.2 protein comprising a modification wherein the region comprising amino acid residues 1077 to 1184 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a M1077S substitution, a L1091G substitution, a S1098A substitution, a C1160M substitution, a V1161H substitution, a W1184V substitution or any combination thereof.

In one embodiment, an ion channel modified to render the ion channel sensitive to a scorpion toxin (e.g. AgTx2) suitable for use with the methods described herein is a Cav1.3 protein comprising a modification wherein the region comprising amino acid residues 1092 to 1199 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a M1092S substitution, a L1106G substitution, a S1113A substitution, a C1175M substitution, a V1176H substitution, a W1199V substitution or any combination thereof.

In one embodiment, an ion channel modified to render the ion channel sensitive to a scorpion toxin (e.g. AgTx2) suitable for use with the methods described herein is a Cav1.4 protein comprising a modification wherein the region comprising amino acid residues 1066 to 1173 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a M1066S substitution, a L1080G substitution, a C1149M substitution, a V1150H substitution, a W1173V or any combination thereof.

In one embodiment, an ion channel modified to render the ion channel sensitive to a scorpion toxin (e.g. AgTx2) suitable for use with the methods described herein is a Cav2.1 protein comprising a modification wherein the region comprising amino acid residues 1454 to 1563 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a L1454S substitution, a V1468G substitution, a C1537M substitution, a I1538H substitution, a W1563V substitution or any combination thereof.

In one embodiment, an ion channel modified to render the ion channel sensitive to a scorpion toxin (e.g. AgTx2) suitable for use with the methods described herein is a Cav2.2 protein comprising a modification wherein the region comprising amino acid residues 1356 to 1465 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a L1356S substitution, a V1370G substitution, a C1439M substitution, a I1440H substitution, a W1465V substitution or any combination thereof.

In one embodiment, an ion channel modified to render the ion channel sensitive to a scorpion toxin (e.g. AgTx2) suitable for use with the methods described herein is a Cav2.3 protein comprising a modification wherein the region comprising amino acid residues 1344 to 1453 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a L1344S substitution, a V1358G substitution, a V1365A substitution, a C1427M substitution, a I1428H substitution, a W1453V substitution or any combination thereof.

In one embodiment, an ion channel modified to render the ion channel sensitive to a scorpion toxin (e.g. AgTx2) suitable for use with the methods described herein is a Cav3.1 protein comprising a modification wherein the region comprising amino acid residues 1193 to 1326 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a A1193S substitution, a N1200G substitution, a G1206D substitution, a R1207A substitution, a V1281M substitution, a V1282H substitution, a T1326V substitution or any combination thereof.

In one embodiment, an ion channel modified to render the ion channel sensitive to a scorpion toxin (e.g. AgTx2) suitable for use with the methods described herein is a Cav3.2 protein comprising a modification wherein the region comprising amino acid residues 1221 to 1344 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a V1221S substitution, a V1222G substitution, a F1228D substitution, a F1229A substitution, a V1299M substitution, a V1230H substitution, a M1344V substitution or any combination thereof.

In one embodiment, an ion channel modified to render the ion channel sensitive to a scorpion toxin (e.g. AgTx2) suitable for use with the methods described herein is a Cav3.3 protein comprising a modification wherein the region comprising amino acid residues 1033 to 1185 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a A1033S substitution, a A1046D substitution, a W1047S substitution, a V1140M substitution, a V1141H substitution, a T1185V substitution or any combination thereof.

In one embodiment, an ion channel modified to render the ion channel sensitive to a scorpion toxin (e.g. AgTx2) suitable for use with the methods described herein is a Kv1.1 protein comprising a modification wherein the region comprising amino acid residues 354 to 381 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a H355G substitution, a Y379H substitution or any combination thereof.

In one embodiment, an ion channel modified to render the ion channel sensitive to a scorpion toxin (e.g. AgTx2) suitable for use with the methods described herein is a Kv1.2 protein comprising a modification wherein the region comprising amino acid residues 355 to 383 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a Q356G substitution, a V381H substitution, a T383V substitution or any combination thereof.

In one embodiment, an ion channel modified to render the ion channel sensitive to a scorpion toxin (e.g. AgTx2) suitable for use with the methods described herein is a Kv1.4 protein comprising a modification wherein the region comprising amino acid residues 506 to 533 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a T506S substitution, a H507G substitution, a K531H substitution, a I533V substitution or any combination thereof.

In one embodiment, an ion channel modified to render the ion channel sensitive to a scorpion toxin (e.g. AgTx2) suitable for use with the methods described herein is a Kv1.5 protein comprising a modification wherein the region comprising amino acid residues 462 to 489 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a T462S substitution, a H463G substitution, a R487H substitution, a I489V substitution or any combination thereof.

In one embodiment, an ion channel modified to render the ion channel sensitive to a scorpion toxin (e.g. AgTx2) suitable for use with the methods described herein is a Kv1.6 protein comprising a modification wherein the region comprising amino acid residues 404 to 431 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a L405 substitution, a Y429H substitution, a M431V substitution or any combination thereof.

In one embodiment, an ion channel modified to render the ion channel sensitive to a scorpion toxin (e.g. AgTx2) suitable for use with the methods described herein is a Kv1.7 protein comprising a modification wherein the region comprising amino acid residues 340 to 367 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a H341G substitution, a E347D substitution, a S348A substitution, a A365H substitution or any combination thereof.

In one embodiment, an ion channel modified to render the ion channel sensitive to a scorpion toxin (e.g. AgTx2) suitable for use with the methods described herein is a Kv1.8 protein comprising a modification wherein the region comprising amino acid residues 403 to 430 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a H404G substitution, a G411A substitution, a C428H substitution, a T430V substitution or any combination thereof.

In one embodiment, an ion channel modified to render the ion channel sensitive to a scorpion toxin (e.g. AgTx2) suitable for use with the methods described herein is a Kv2.1 protein comprising a modification wherein the region comprising amino acid residues 359 to 386 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a T359S substitution, a K360G substitution, a A366D substitution, a S367A substitution, a I383M substitution, a Y384H substitution, a K386V or any combination thereof.

In one embodiment, an ion channel modified to render the ion channel sensitive to a scorpion toxin (e.g. AgTx2) suitable for use with the methods described herein is a Kv2.2 protein comprising a modification wherein the region comprising amino acid residues 363 to 390 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a T363S substitution, a K364G substitution, a A370D substitution, a S371A substitution, a I387M substitution, a Y388H substitution, a K390V substitution or any combination thereof.

In one embodiment, an ion channel modified to render the ion channel sensitive to a scorpion toxin (e.g. AgTx2) suitable for use with the methods described herein is a Kv3.1 protein comprising a modification wherein the region comprising amino acid residues 382 to 409 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a T382S substitution, a H383G substitution, a I389D substitution, a G390A substitution, a Y407H substitution, a Q409V substitution or any combination thereof.

In one embodiment, an ion channel modified to render the ion channel sensitive to a scorpion toxin (e.g. AgTx2) suitable for use with the methods described herein is a Kv3.2 protein comprising a modification wherein the region comprising amino acid residues 419 to 446 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a T419S substitution, a Q420G substitution, a I426D substitution, a G427A substitution, a Y444H substitution, a Q446V substitution or any combination thereof.

In one embodiment, an ion channel modified to render the ion channel sensitive to a scorpion toxin (e.g. AgTx2) suitable for use with the methods described herein is a Kv3.3 protein comprising a modification wherein the region comprising amino acid residues 485 to 512 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a T485S substitution, a Y486G substitution, a I492D substitution, a G493A substitution, a Y510H substitution, a K512V substitution or any combination thereof.

In one embodiment, an ion channel modified to render the ion channel sensitive to a scorpion toxin (e.g. AgTx2) suitable for use with the methods described herein is a Kv3.4 protein comprising a modification wherein the region comprising amino acid residues 418 to 445 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a T418S substitution, a D419G substitution, a I425D substitution, a G426A substitution, a Y443H substitution, a K445V substitution or any combination thereof.

In one embodiment, an ion channel modified to render the ion channel sensitive to a scorpion toxin (e.g. AgTx2) suitable for use with the methods described herein is a Kv4.1 protein comprising a modification wherein the region comprising amino acid residues 354 to 381 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a T354S substitution, a N355G substitution, a A361D substitution, a V379H substitution, a S381V substitution or any combination thereof.

In one embodiment, an ion channel modified to render the ion channel sensitive to a scorpion toxin (e.g. AgTx2) suitable for use with the methods described herein is a Kv4.2 protein comprising a modification wherein the region comprising amino acid residues 352 to 379 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a K353G substitution, a A359D substitution, a V377H substitution, a K379V substitution or any combination thereof.

In one embodiment, an ion channel modified to render the ion channel sensitive to a scorpion toxin (e.g. AgTx2) suitable for use with the methods described herein is a Kv4.3 protein comprising a modification wherein the region comprising amino acid residues 349 to 376 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a K350G substitution, a A356D substitution, a S357A substitution, a V374H substitution, a K376V substitution or any combination thereof.

In one embodiment, an ion channel modified to render the ion channel sensitive to a scorpion toxin (e.g. AgTx2) suitable for use with the methods described herein is a Kv5.1 protein comprising a modification wherein the region comprising amino acid residues 352 to 379 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a T352S substitution, a L353G substitution, a Q359D substitution, a S360A substitution, a I376M substitution, a Y377H substitution, a K379V substitution or any combination thereof.

In one embodiment, an ion channel modified to render the ion channel sensitive to a scorpion toxin (e.g. AgTx2) suitable for use with the methods described herein is a Kv6.1 protein comprising a modification wherein the region comprising amino acid residues 406 to 433 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a P406S substitution, a E407G substitution, a A413D substitution, a C414A substitution, a V431H substitution, a R433V substitution or any combination thereof.

In one embodiment, an ion channel modified to render the ion channel sensitive to a scorpion toxin (e.g. AgTx2) suitable for use with the methods described herein is a Kv6.2 protein comprising a modification wherein the region comprising amino acid residues 351 to 378 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a R351S substitution, a D352G substitution, a A358D substitution, a S359A substitution, a V376H substitution, a R378V substitution or any combination thereof.

In one embodiment, an ion channel modified to render the ion channel sensitive to a scorpion toxin (e.g. AgTx2) suitable for use with the methods described herein is a Kv6.3 protein comprising a modification wherein the region comprising amino acid residues 350 to 380 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a L350S substitution, a T351G substitution, a T358D substitution, a S359A substitution, a Y380H substitution or any combination thereof.

In one embodiment, an ion channel modified to render the ion channel sensitive to a scorpion toxin (e.g. AgTx2) suitable for use with the methods described herein is a Kv6.4 protein comprising a modification wherein the region comprising amino acid residues 400 to 427 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a L400S substitution, a E401G substitution, a A407D substitution, a S408A substitution, a V425H substitution, a R427V substitution or any combination thereof.

In one embodiment, an ion channel modified to render the ion channel sensitive to a scorpion toxin (e.g. AgTx2) suitable for use with the methods described herein is a Kv7.1 protein comprising a modification wherein the region comprising amino acid residues 403 to 454 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a H403S substitution, a K411G substitution, a Y417D substitution, a V418A substitution, a C445M substitution, a D446H substitution, a D454V substitution or any combination thereof.

In one embodiment, an ion channel modified to render the ion channel sensitive to a scorpion toxin (e.g. AgTx2) suitable for use with the methods described herein is a Kv7.2 protein comprising a modification wherein the region comprising amino acid residues 460 to 535 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a A469S substitution, a S461G substitution, a R489D substitution, a S490A substitution, a E530M substitution, a D531H substitution, a G535V substitution or any combination thereof.

In one embodiment, an ion channel modified to render the ion channel sensitive to a scorpion toxin (e.g. AgTx2) suitable for use with the methods described herein is a Kv7.3 protein comprising a modification wherein the region comprising amino acid residues 482 to 539 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a A482S substitution, a S487G substitution, a G493D substitution, a D494A substitution, a K532M substitution, a K533H substitution, a R539V substitution or any combination thereof.

In one embodiment, an ion channel modified to render the ion channel sensitive to a scorpion toxin (e.g. AgTx2) suitable for use with the methods described herein is a Kv7.4 protein comprising a modification wherein the region comprising amino acid residues 431 to 461 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a R441D substitution, a P459M substitution, a T460H substitution, a M461V substitution or any combination thereof.

In one embodiment, an ion channel modified to render the ion channel sensitive to a scorpion toxin (e.g. AgTx2) suitable for use with the methods described herein is a Kv7.5 protein comprising a modification wherein the region comprising amino acid residues 485 to 542 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a K485S substitution, a V487G substitution, a A493D substitution, a L494A substitution, a R535M substitution, a K536H substitution, a R542V substitution or any combination thereof.

In one embodiment, an ion channel modified to render the ion channel sensitive to a scorpion toxin (e.g. AgTx2) suitable for use with the methods described herein is a Kv8.1 protein comprising a modification wherein the region comprising amino acid residues 374 to 401 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a T374S substitution, a T375G substitution, a C381D substitution, a I398M substitution, a F399H substitution, a D401V substitution or any combination thereof.

In one embodiment, an ion channel modified to render the ion channel sensitive to a scorpion toxin (e.g. AgTx2) suitable for use with the methods described herein is a Kv8.2 protein comprising a modification wherein the region comprising amino acid residues 439 to 466 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a T439S substitution, a N440G substitution, a H446D substitution, a S447A substitution, a Y464H substitution, a E466V substitution or any combination thereof.

In one embodiment, an ion channel modified to render the ion channel sensitive to a scorpion toxin (e.g. AgTx2) suitable for use with the methods described herein is a Kv9.1 protein comprising a modification wherein the region comprising amino acid residues 405 to 431 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a F405S substitution, a A410D substitution, a C411A substitution, a V427M substitution, a V428H substitution or any combination thereof.

In one embodiment, an ion channel modified to render the ion channel sensitive to a scorpion toxin (e.g. AgTx2) suitable for use with the methods described herein is a Kv9.2 protein comprising a modification wherein the region comprising amino acid residues 358 to 384 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a L358S substitution, a A363D substitution, a C364A substitution, a V380M substitution, a V381H substitution, a G384V substitution or any combination thereof.

In one embodiment, an ion channel modified to render the ion channel sensitive to a scorpion toxin (e.g. AgTx2) suitable for use with the methods described herein is a Kv9.3 protein comprising a modification wherein the region comprising amino acid residues 358 to 384 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a L358S substitution, a A363D substitution, a C364A substitution, a V380M substitution, a V381H substitution, a G384V substitution or any combination thereof.

In one embodiment, an ion channel modified to render the ion channel sensitive to a scorpion toxin (e.g. AgTx2) suitable for use with the methods described herein is a Kv10.1 protein comprising a modification wherein the region comprising amino acid residues 501 to 561 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a I501S substitution, a Y506G substitution, a Y512D substitution, a H513A substitution, a K554M substitution, a V555H substitution, a K561V substitution or any combination thereof.

In one embodiment, an ion channel modified to render the ion channel sensitive to a scorpion toxin (e.g. AgTx2) suitable for use with the methods described herein is a Kv10.2 protein comprising a modification wherein the region comprising amino acid residues 470 to 530 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a I470S substitution, a Y475G substitution, a Y481D substitution, a H482A substitution, a K523M substitution, a V524H substitution, a K530V substitution or any combination thereof.

In one embodiment, an ion channel modified to render the ion channel sensitive to a scorpion toxin (e.g. AgTx2) suitable for use with the methods described herein is a Kv11.1 protein comprising a modification wherein the region comprising amino acid residues 662 to 722 is replaced with the sequence of amino acids 426 to 453 of Kv1.3. In one embodiment, an ion channel modified to render the ion channel sensitive to a scorpion toxin (e.g.

AgTx2) suitable for use with the methods described herein comprises a I1662S substitution, a S668G substitution, a H674D substitution, a T675A substitution, a A715M substitution, a V716H substitution, a E722V substitution or any combination thereof.

In one embodiment, an ion channel modified to render the ion channel sensitive to a scorpion toxin (e.g. AgTx2) suitable for use with the methods described herein is a Kv11.2 protein comprising a modification wherein the region comprising amino acid residues 514 to 574 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a 1514S substitution, a S520G substitution, a H526D substitution, a T527A substitution, a A567M substitution, a V568H substitution, a E574V substitution or any combination thereof.

In one embodiment, an ion channel modified to render the ion channel sensitive to a scorpion toxin (e.g. AgTx2) suitable for use with the methods described herein is a Kv11.3 protein comprising a modification wherein the region comprising amino acid residues 665 to 725 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a I1665S substitution, a S671G substitution, a H677D substitution, a M678A substitution, a V719H substitution, a E725V substitution or any combination thereof.

In one embodiment, an ion channel modified to render the ion channel sensitive to a scorpion toxin (e.g. AgTx2) suitable for use with the methods described herein is a Kv12.1 protein comprising a modification wherein the region comprising amino acid residues 472 to 532 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a I1472S substitution, a Y477G substitution, a Y483D substitution, a H484A substitution, a E525M substitution, a L526H substitution, a D532V substitution or any combination thereof.

In one embodiment, an ion channel modified to render the ion channel sensitive to a scorpion toxin (e.g. AgTx2) suitable for use with the methods described herein is a Kv12.2 protein comprising a modification wherein the region comprising amino acid residues 503 to 563 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a I503S substitution, a Y508G substitution, a Y514D substitution, a H515A substitution, a E556M substitution, a L557H substitution, a D563V substitution or any combination thereof.

In one embodiment, an ion channel modified to render the ion channel sensitive to a scorpion toxin (e.g. AgTx2) suitable for use with the methods described herein is a Kv12.3 protein comprising a modification wherein the region comprising amino acid residues 477 to 533 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a I477S substitution, a Y482G substitution, a Y488D substitution, a H489A substitution, a E530M substitution, a L531H substitution, a D533V substitution or any combination thereof.

In one embodiment, an ion channel modified to render the ion channel sensitive to a scorpion toxin (e.g. AgTx2) suitable for use with the methods described herein is a HCN1 protein comprising a modification wherein the region comprising amino acid residues 504 to 543 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a R504S substitution, a M512D substitution, a Y513A substitution, a S536M substitution, a Y537H substitution, a L543V substitution or any combination thereof.

In one embodiment, an ion channel modified to render the ion channel sensitive to a scorpion toxin (e.g. AgTx2) suitable for use with the methods described herein is a HCN2 protein comprising a modification wherein the region comprising amino acid residues 573 to 612 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a R573S substitution, a M581D substitution, a Y582A substitution, a S605M substitution, a Y606H substitution, a L612V substitution or any combination thereof.

In one embodiment, an ion channel modified to render the ion channel sensitive to a scorpion toxin (e.g. AgTx2) suitable for use with the methods described herein is a HCN3 protein comprising a modification wherein the region comprising amino acid residues 457 to 496 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a R457S substitution, a M465D substitution, a Y466A substitution, a S489M substitution, a Y490H substitution, a L496V substitution or any combination thereof.

In one embodiment, an ion channel modified to render the ion channel sensitive to a scorpion toxin (e.g. AgTx2) suitable for use with the methods described herein is a HCN4 protein comprising a modification wherein the region comprising amino acid residues 624 to 663 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a R624S substitution, a M632D substitution, a Y633A substitution, a S656M substitution, a Y657H substitution, a L663V substitution or any combination thereof.

In one embodiment, an ion channel modified to render the ion channel sensitive to a scorpion toxin (e.g. AgTx2) suitable for use with the methods described herein is a CatSper1 protein comprising a modification wherein the region comprising amino acid residues 393 to 424 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a T393S substitution, a S387G substitution, a W394A substitution, a S418M substitution, a T419H substitution, a W424V substitution or any combination thereof.

In one embodiment, an ion channel modified to render the ion channel sensitive to a scorpion toxin (e.g. AgTx2) suitable for use with the methods described herein is a CatSper2 protein comprising a modification wherein the region comprising amino acid residues 399 to 431 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a R399S substitution, a S401G substitution, a V407D substitution, a S408A substitution, a S426M substitution, a K427H substitution, a T431V substitution or any combination thereof.

In one embodiment, an ion channel modified to render the ion channel sensitive to a scorpion toxin (e.g. AgTx2) suitable for use with the methods described herein is a CatSper3 protein comprising a modification wherein the region comprising amino acid residues 297 to 329 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a I297S substitution, a H310D substitution, a I311A substitution, a E325M substitution, a N326H substitution, a K329V substitution or any combination thereof.

In one embodiment, an ion channel modified to render the ion channel sensitive to a scorpion toxin (e.g. AgTx2) suitable for use with the methods described herein is a CatSper4 protein comprising a modification wherein the region comprising amino acid residues 299 to 336 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a I299S substitution, a I304D substitution, a V305A substitution, a E333M substitution, a E334H substitution or any combination thereof.

In one embodiment, an ion channel modified to render the ion channel sensitive to a scorpion toxin (e.g. AgTx2) suitable for use with the methods described herein is an Hv1 protein comprising a modification wherein the region comprising amino acid residues 218 to 248 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a I218S substitution, a R223D substitution, a S224A substitution, a A240M substitution, a K241H substitution, a S248V substitution or any combination thereof.

In one embodiment, an ion channel modified to render the ion channel sensitive to a scorpion toxin (e.g. AgTx2) suitable for use with the methods described herein is a KCa1.1 protein comprising a modification wherein the region comprising amino acid residues 723 to 785 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a N723S substitution, a N726G substitution, a M732D substitution, a R733A substitution, a F761M substitution, a S785V substitution or any combination thereof.

In one embodiment, an ion channel modified to render the ion channel sensitive to a scorpion toxin (e.g. AgTx2) suitable for use with the methods described herein is a KCa4.1 protein comprising a modification wherein the region comprising amino acid residues 723 to 807 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a L723S substitution, a D730G substitution, a V736D substitution, a T737A substitution, a S789M substitution, a Y790H substitution, a A807V substitution or any combination thereof.

In one embodiment, an ion channel modified to render the ion channel sensitive to a scorpion toxin (e.g. AgTx2) suitable for use with the methods described herein is a KCa4.2 protein comprising a modification wherein the region comprising amino acid residues 642 to 725 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a Q642S substitution, a D649G substitution, a T655D substitution, a T656A substitution, a Y707M substitution, a Y708H substitution, a A725V substitution or any combination thereof.

In one embodiment, an ion channel modified to render the ion channel sensitive to a scorpion toxin (e.g. AgTx2) suitable for use with the methods described herein is a TPC1 protein comprising a modification wherein the region comprising amino acid residues 659 to 696 is replaced with the sequence of amino acids 426 to 453 of Kv1.3. In one embodiment, an ion channel modified to render the ion channel sensitive to a scorpion toxin (e.g. AgTx2) suitable for use with the methods described herein comprises a E659S substitution, a C669G substitution, a V675D substitution, a V691M substitution, a V692H substitution, a Y696V substitution or any combination thereof.

Voltage-Sensitive Phosphatases

The methods described herein can also be used to identify compounds that modulate the activity of voltage-sensitive phosphatases (VSPs). VSPs are four-transmembrane proteins that contain the characteristic voltage sensor domain of an ion channel, but instead of controlling an ion pore, the voltage sensor is linked to a cytoplasmic phosphoinositide phosphatase (Murata et al., 2005). One of skill in the art will appreciate that the amino acid substitutions described herein for inducing omega or sigma leaks can also be used to generate VSPs having altered voltage sensitivity. The prototypical member of the VSP family is the voltage-sensor containing phosphatase (called CiVSP) isolated from Ciona intestinalis (sea squirt; see Murata et al. (2005) Phosphoinositide phosphatase activity coupled to an intrinsic voltage sensor. Nature 435(7046):1239-1243). This enzyme consists of an intracellular phosphatase segment the activity of which is controlled by membrane voltage acting via a VSD with strong sequence homology to those VSDs found in VGSC, VGCC, and VGPC alpha subunits; the VSD in CiVSP family members appears to act as a monomeric unit. (see, e.g., Okamura et al. (2009) Voltage-sensing phosphatase: actions and potentials. J Physiol. 587(Pt 3):513-520). Orthologues of CiVSP are found in humans, rodents, birds, and fishes (Okamura & Dixon (2011) Voltage-sensing phosphatase: its molecular relationship with PTEN. Physiology (Bethesda). 26(1):6-13). At least one human orthologue exists, phosphatidylinositol-3,4,5-triphosphate 3-phosphatase TPTE2, http://www uniprot.org/uniprot/Q6XPS3.

A multiple alignment of various VSPs and human Kv2.1 is provided in FIG. 31. One of skill in the art will be capable of generating a VSP having altered voltage sensitivity by replacing one of more gating arginines, lysines or histidines in the S4 helix of the VSP with a substituent residue having an uncharged polar side chain or with an amino acid residue not having a positively charged side chain.

In one embodiment, an VSP having an altered voltage sensitivity suitable for use with the methods described herein will be a CiVSP protein comprising an amino acid substitution of one or more S4 helix gating charge amino acid residues at any of positions R223, R226, R229 or R232 wherein the substitution replaces the positively charged arginine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an S2 gating charge transport mutation suitable for use with the methods described herein will be a CiVSP protein comprising a substitution of the tyrosine at position 160 with an amino acid that is less hydrophobic than tyrosine wherein the substituted protein has faster deactivation kinetics relative to activation or a substitution of the tyrosine at position 160 with an amino acid that is more hydrophobic than tyrosine wherein the substituted protein has slower deactivation kinetics relative to activation.

In one embodiment, an VSP having an altered voltage sensitivity suitable for use with the methods described herein will be a DrVSP protein comprising an amino acid substitution of one or more S4 helix gating charge amino acid residues at any of positions R159, R162, R168 or R171, wherein the substitution replaces the positively charged arginine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an S2 gating charge transport mutation suitable for use with the methods described herein will be a DrVSP protein comprising a substitution of the phenylalanine at position 100 with an amino acid that is less hydrophobic than phenylalanine wherein the substituted protein has faster deactivation kinetics relative to activation or a substitution of the phenylalanine at position 100 with an amino acid that is more hydrophobic than phenylalanine wherein the substituted protein has slower deactivation kinetics relative to activation.

In one embodiment, an VSP having an altered voltage sensitivity suitable for use with the methods described herein will be a TPIP protein comprising an amino acid substitution of one or more S4 helix gating charge amino acid residues at any of positions R100, R103, R109 or H112, wherein the substitution replaces the positively charged arginine or histidine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an S2 gating charge transport mutation suitable for use with the methods described herein will be a TPIP protein comprising a substitution of the phenylalanine at position 81 with an amino acid that is less hydrophobic than phenylalanine wherein the substituted protein has faster deactivation kinetics relative to activation or a substitution of the phenylalanine at position 81 with an amino acid that is more hydrophobic than phenylalanine wherein the substituted protein has slower deactivation kinetics relative to activation.

In one embodiment, an VSP having an altered voltage sensitivity suitable for use with the methods described herein will be a TPET2 protein comprising an amino acid substitution of one or more S4 helix gating charge amino acid residues at any of positions R177, R180, R186 or H189, wherein the substitution replaces the positively charged arginine or histidine residue with an amino acid substituent residue having an uncharged polar side chain or with an amino acid residue not having a positively charged side chain. In one embodiment, the amino acid substitute at the gating charge position is a serine or an asparagine.

In one embodiment, an ion channel having an S2 gating charge transport mutation suitable for use with the methods described herein will be a TPET2 protein comprising a substitution of the phenylalanine at position 110 with an amino acid that is less hydrophobic than phenylalanine wherein the substituted protein has faster deactivation kinetics relative to activation or a substitution of the phenylalanine at position 110 with an amino acid that is more hydrophobic than phenylalanine wherein the substituted protein has slower deactivation kinetics relative to activation.

Similarly, one of skill in the art will readily be able to design VSP mutants having altered voltage sensitivity on the basis of the L287C, F289C mutations in Kv2.1 (with or without MTSES or MTSET) or the C236S, V292C, and R294G mutations in Kv2.1 described herein.

Variants

The VGPs described herein can also comprise one or more non-conservative substitutions. In certain aspects, the methods described herein relate to methods for monitoring the activity of variant VGP comprising one or more substituted amino acids and wherein the substituted amino acid is an amino acid having: (a) a similar side chain group, or (b) a similar side chain configuration, or (c) evolutionary positive relatedness, or (d) evolutionary neutral relatedness, or a nucleic acid encoding the same. Thus, as used herein, the term VGP can also refer to any variant VGP described herein, including, but not limited to variants comprising one or more amino acid substitutions with an amino acid having a similar side chain group, an amino acid having a similar side chain configuration, an amino acid having an evolutionary positive relatedness, or an amino acid having an evolutionary neutral relatedness.

In one embodiment, a variant VGP comprises an amino acid sequence having at least about 75%, 80%, 85%, 90%, 95%, 98%, 99% identity with an amino acid sequence of Nav1.1, Nav1.2, Nav1.3, Nav1.4, Nav1.5, Nav1.6, Nav1.7, Nav1.8, Nav1.9, Cav1.1, Cav1.2, Cav1.3, Cav1.4, Cav2.1, Cav2.2, Cav2.3, Cav3.1, Cav3.2, Cav3.3, Kv1.1, Kv1.2, Kv1.3, Kv1.4, Kv1.5, Kv1.6, Kv1.7, Kv1.8, Kv2.1, Kv2.2, Kv3.1, Kv3.2, Kv3.3, Kv3.4, Kv4.1, Kv4.2, Kv4.3, Kv5.1, Kv6.1, Kv6.2, Kv6.3, Kv6.4, Kv7.1, Kv7.2, Kv7.3, Kv7.4, Kv7.5, Kv8.1, Kv8.2, Kv9.1, Kv9.2, Kv9.3, Kv10.1, Kv10.2, Kv11.1, Kv11.2, Kv11.3, Kv12.1, Kv12.2, Kv12.3, HCN1, HCN2, HCN3, HCN4, CatSper1, CatSper2, CatSper3, CatSper4, Hv1, KCa1.1, KCa4.1, KCa4.2, TPC1, *Drosophila* Shaker, or any other VGIC. In one embodiment, a variant VGP comprises an amino acid sequence having at least about 75%, 80%, 85%, 90%, 95%, 98%, 99% identity with an amino acid sequence of a VSP or a VGP described herein or known in the art.

As used herein, "sequence identity" means the percentage of identical nucleotide or amino acid residues at corresponding positions in two or more sequences when the sequences are aligned to maximize sequence matching, i.e., taking into account gaps and insertions. The comparison of sequences and determination of percent identity between two sequences can be accomplished using a mathematical algorithm. Techniques for determining sequence identity are well known to one skilled in the art, and include, for example, analysis with a sequence comparison algorithm or FASTA version 3.0t78 using default parameters (Pearson and Lipman, Proc Natl Acad Sci USA. 1988 April; 85(8):2444-8). In another non-limiting example, scoring of amino acid can be calculated using the PAM250 matrix as described in Dayhoff et al., (1978) in Atlas of Protein Sequence and Structure, ed. Dayhoff, M. (Natl. Biomed. Res. Found., Silver Spring, Md.), Vol. 5, Suppl. 3, pp. 345-352.

Percent identity or percent similarity of a polypeptide sequence can be determined, for example, by comparing sequence information using the GAP computer program. The GAP program utilizes the alignment method of Needleman et al., 1970, as revised by Smith et al., 1981. Briefly, the GAP program defines similarity as the number of aligned symbols (i.e., nucleotides or amino acids) that are similar, divided by the total number of symbols in the shorter of the two sequences. The preferred parameters for the GAP program are the default parameters, which do not impose a penalty for end gaps. See e.g., Schwartz et al., 1979; Gribskov et al., 1986. Nucleic acids that differ due to degeneracy of the genetic code, and still encode the VGICs or variant VGICs, described herein are encompassed by the present disclosure.

VGPs falling within the scope of this invention can be produced by any number of methods, including but not limited to, error-prone PCR, shuffling, oligonucleotide-directed mutagenesis, assembly PCR, PCR mutagenesis, in vivo mutagenesis, cassette mutagenesis, recursive ensemble mutagenesis, exponential ensemble mutagenesis, site-specific mutagenesis, gene reassembly, and any combination thereof.

A variant VGP can comprise a conservative amino acid substitution in which an amino acid residue is replaced with an amino acid substituent residue having a similar side chain group. VGPs falling within the scope of this invention, can, in general, be accomplished by selecting substitutions that do not differ significantly in their effect on maintaining (a) the structure of the polypeptide backbone in the area of the substitution, (b) the charge or hydrophobicity of the molecule at the target site, or (c) the bulk of the side chain.

The VGPs described herein can be labeled, e.g., with a fluorophore or other detectable moiety, and/or fused to a polypeptide such as GFP, RFP, BFP and YFP. Suitable labels include but are not limited to a nucleic acid molecule, i.e., DNA or RNA, e.g., an oligonucleotide, a protein, e.g., a luminescent protein, a polypeptide, for instance, an epitope recognized by a ligand, for instance, maltose and maltose binding protein, biotin and avidin or streptavidin and a His tag and a metal, such as cobalt, zinc, nickel or copper, a hapten, e.g., molecules useful to enhance immunogenicity such as keyhole limpet hemacyanin (KLH), cleavable labels, for instance, photocleavable biotin, a fluorophore, a chromophore, and the like.

VGPs fused to a fluorescent proteins (or non-fluorescent chromoproteins) can be readily generated by methods known in the art. Such fluorescent fusion proteins (or non-fluorescent chromoproteins) can be used to detect protein interaction by several methods, including but not limited to immunoprecipitation and fluorescence resonance energy transfer (FRET). A fluorescent protein (or non-fluorescent chromoprotein) can be specifically linked to the amino- or carboxyl-terminus of a VGP sequence using well known chemical methods, see, e.g., *Chemical Approaches to Protein Engineering*, in Protein Engineering: A Practical Approach (Eds. Rees et al., Oxford University Press, 1992). A fluorescent protein (or non-fluorescent chromoprotein) can also be specifically inserted in-frame within a VGIC using well known chemical methods.

Fluorescent proteins (or non-fluorescent chromoproteins) useful in aspects of the invention include, e.g., those which have been genetically engineered for superior performance such as, without limitation, altered excitation or emission wavelengths; enhanced brightness, pH resistance, stability or speed of fluorescent protein formation; photoactivation; or reduced oligomerization or photobleaching, see, e.g., Brendan P. Cormack et al., *FACS—optimized Mutants of the Green Fluorescent Protein (GFP)*, U.S. Pat. No. 5,804,387 (Sep. 8, 1998); Roger Y. Tsien & Roger Heim, *Modified Green Fluorescent Proteins*, U.S. Pat. No. 6,800,733 (Oct. 5, 2004); Roger Y. Tsien et al., *Long Wavelength Engineered Fluorescent Proteins*, U.S. Pat. No. 6,780,975 (Aug. 24, 2004); and Roger Y. Tsien et al., *Fluorescent Protein Sensors For Measuring the pH of a Biological Sample*, U.S. Pat. No. 6,627,449 (Sep. 30, 2003).

In one embodiment, the VGPs described herein can also be coupled with a radioisotope or enzymatic label to facilitate their detection. For example, the VGPs described herein can be isotopically-labeled where one or more atoms are replaced or substituted by an atom having an atomic mass or mass number different from the atomic mass or mass number typically found in nature (i.e., naturally occurring). Suitable radionuclides that may be incorporated in compounds of the present invention include but are not limited to $^{2}$H (also written as D for deuterium), $^{3}$H (also written as T for tritium), $^{11}$C, $^{13}$C, $^{14}$C, $^{13}$N, $^{15}$N, $^{15}$O, $^{17}$O, $^{18}$O, $^{18}$F, $^{35}$S, $^{36}$Cl, $^{82}$Br, $^{75}$Br, $^{76}$Br, $^{77}$Br, $^{123}$I, $^{124}$I, $^{125}$I and $^{131}$I. The radionuclide that is incorporated in the instant radio-labeled compounds can depend on the specific application of that radio-labeled compound.

Alternatively, the VGPs described herein can be enzymatically labeled with, for example, horseradish peroxidase, alkaline phosphatase, or luciferase, and the enzymatic label detected by determination of conversion of an appropriate substrate to product.

In another embodiment, the VGPs described herein can be labeled with a fluorescent dye, spin label, heavy metal or radio-labeled peptides.

In another embodiment, the VGPs described herein can comprise a non-natural amino acid. As used herein, a non-natural amino acid can be, but is not limited to, an amino acid comprising a moiety where a chemical moiety is attached, such as an aldehyde- or keto-derivatized amino acid, or a non-natural amino acid that includes a chemical moiety. A non-natural amino acid can also be an amino acid comprising a moiety where a saccharide moiety can be attached, or an amino acid that includes a saccharide moiety. Examples of non-classical amino acids suitable for use with the methods and compositions described herein include, but are not limited to, D-isomers of the common amino acids, 2,4-diaminobutyric acid, alpha-amino isobutyric acid, 4-aminobutyric acid, Abu, 2-amino butyric acid, gamma-Abu, epsilon-Ahx, 6-amino hexanoic acid, Aib, 2-amino isobutyric acid, 3-amino propionic acid, ornithine, norleucine, norvaline, hydroxyproline, sarcosine, citrulline, homocitrulline, cysteic acid, t-butylglycine, t-butylalanine, phenylglycine, cyclohexylalanine, beta-alanine, fluoro-amino acids, designer amino acids such as beta-methyl amino acids, C alpha-methyl amino acids, N alpha-methyl amino acids, and amino acid analogs in general.

The VGPs described herein can also comprise one or more amino acid analog substitutions, e.g., unnatural amino acids such as alpha alpha-disubstituted amino acids, N-alkyl amino acids, lactic acid, and the like. These analogs include phosphoserine, phosphothreonine, phosphotyrosine, hydroxyproline, gamma-carboxyglutamate; hippuric acid, octahydroindole-2-carboxylic acid, statine, 1,2,3,4,-tetrahydroisoquinoline-3-carboxylic acid, penicillamine, ornithine, citruline, .alpha.-methyl-alanine, para-benzoyl-phenylalanine, phenylglycine, propargylglycine, sarcosine, .epsilon.-N,N,N-trimethyllysine, .epsilon.-N-acetyllysine, N-acetyl-serine, N-formylmethionine, 3-methylhistidine, 5-hydroxylysine, .omega.-N-methylarginine, and other similar amino acids and imino acids and tert-butylglycine.

The VGPs described herein can further comprise polypeptide analogs, such as peptide mimetics (Fauchere J, Adv. Drug Res. 15:29 (1986); Veber D F and Freidinger R M, Trends Neurosci. 8:392-96 (1985); Evans B E et al., J. Med. Chem 30:1229-39 (1987)). Generally, peptidomimetics are structurally similar to a template polypeptide (i.e., a polypeptide that has a biological or pharmacological activity), such as the VGPs described herein, but have one or more peptide linkages replaced by a linkage selected from the group consisting of: —CH.sub.2NH—, —CH.sub.2S—, —CH.sub.2-CH.sub.2-, —CH.dbd.CH— (cis and trans), —COCH.sub.2-, —CH(OH)CH.sub.2-, and —CH.sub.2SO—, by methods known in the art and further described in the following references: Spatola A F in "Chemistry and Biochemistry of Amino Acids, Peptides, and Proteins," B. Weinstein, ed., Marcel Dekker, New York, p. 267 (1983); Spatola, A F, Vega Data (March 1983), Vol. 1, Issue 3, "Peptide Backbone Modifications"; Morley J S, Trends Pharmcol. Sci. 1:463-68 (1980); Hudson D et al., Int. J. Pept. Prot. Res. 14:177-85 (1979) (—CH.sub.2NH—, CH.sub.2CH.sub.2-); Spatola A F et al., Life Sci. 38:1243-49 (1986) (—CH.sub.2-S); Hann M M, J. Chem. Soc. Perkin Trans. 1, 307-314 (1982) (—CH—CH—, cis and trans); Almquist R G et al., J. Med. Chem. 23:1392-98 (1980) (—COCH.sub.2-); Jennings-White C et al., Tetrahedron Lett. 23:2533-34 (1982) (—COCH.sub.2-); EP 0 045 665 (—CH(OH)CH.sub.2-); Holladay M W et al., Tetrahedron Lett., 24:4401-04 (1983) (—C(OH)CH.sub.2-); Hruby V J, Life Sci. 31:189-99 (1982) (—CH.sub.2-S—). One example of a non-peptide linkage is —CH.sub.2NH—.

Such polypeptide mimetics can have advantages over polypeptide embodiments, including, for example: more economical production, greater chemical stability, enhanced pharmacological properties (half-life, absorption, potency, efficacy, etc.), altered specificity (e.g., a broad-spectrum of biological activities), reduced antigenicity, and others. Labeling of peptidomimetics can involve covalent attachment of one or more labels, directly or through a spacer (e.g., an amide group), to non-interfering position(s) on the peptidomimetic that are predicted by quantitative structure-activity data and/or molecular modeling. Such non-interfering positions can be positions that do not from direct contacts with the macromolecules(s) to which the peptidomimetic binds to produce the therapeutic effect. Derivatization (e.g., labeling) of peptidomimetics can be done without substantially interfering with the desired biological or pharmacological activity of the peptidomimetic. The ability of any peptidomimetics to polypeptides can be assayed for the ability to bind 1,4,-benzothiazepine or derivatives thereof using methods know to those skilled in the art.

Chemically modified derivatives of the VGPs described herein can also be prepared. For example, amides of the VGPs described herein can be prepared by techniques well known in the art for converting a carboxylic acid group or precursor, to an amide. One method for amide formation at the C-terminal carboxyl group is to cleave the polypeptide, or fusion thereof from a solid support with an appropriate amine, or to cleave in the presence of an alcohol, yielding an ester, followed by aminolysis with the desired amine.

N-acyl derivatives of an amino group of the VGPs described herein can be prepared by utilizing an N-acyl protected amino acid for the final condensation, or by acylating a protected or unprotected polypeptide, or fusion thereof. O-acyl derivatives can be prepared, for example, by acylation of a free hydroxy polypeptide or polypeptide resin. Either acylation can be carried out using standard acylating reagents such as acyl halides, anhydrides, acyl imidazoles, and the like. Both N- and O-acylation can be carried out together, if desired.

Formyl-methionine, pyroglutamine and trimethyl-alanine can be substituted at the N-terminal residue of VGPs described herein. Other amino-terminal modifications include aminooxypentane modifications.

Systematic substitution of one or more amino acids of the VGPs described herein with a D-amino acid of the same type (e.g., D-lysine in place of L-lysine) can be used to generate additional amino acid sequence variants.

Expression Systems

Expression of VGPs described herein can be by any method known in the art and include both cell-based expression systems and cell-free expression systems. For example, polypeptide of this invention can be expressed in bacterial cells, insect cells (e.g., using baculovirus expression vectors), yeast cells, amphibian cells, or mammalian cells. Suitable host cells are well known to one skilled in the art. For other suitable expression systems for both prokaryotic and eukaryotic cells, see chapters 16 and 17 of Sambrook, J., Fritsh, E. F., and Maniatis, T. *Molecular Cloning: A Laboratory Manual,* 2nd ed., Cold Spring Harbor Laboratory, Cold Spring Harbor Laboratory Press, Cold Spring Harbor, N.Y., 1989.

The VGPs described herein can be expressed in any suitable cell line including oocytes. Cell lines suitable for expressing the VGPs described herein can be of mammalian, amphibian, eukaryotic, archeal, or bacterial origin. Both transient and stable methods of expression can be used in conjunction with the methods described herein. Alternatively the VGPs can be incorporated into a planar lipid bilayer, a liposome, or a functional equivalent thereof. The VSDs can also be expressed, or incorporated, either alone, or as part of either the complete or partial VGP from which the VSD was originally derived, or as a part of a fusion protein with another (partial or complete) VGP, or as part of a fusion protein with another, unrelated protein.

Numerous methods exist for producing a VGP for analysis according to the methods described herein. Such methods, include, but are not limited to, exogenous expression systems. For example, VGPs can be expressed exogenously in frog oocytes or cell lines (e.g., embryonic kidney cells) to examine the behavior of populations of VGPs expressed at higher levels relative to endogenous VGPs. One of skill in the art will readily understand that expression of a VGP in an exogenous system may not account for interacting accessory proteins, a cell environment that differs from the cell environment in which the VGP is normally expressed, differences in protein turnover, expression level artifacts, and improper trafficking to subcellular compartments in an artificial system. Methods are also known in the art for expressing and characterizing VGP in whole organisms such as genetically engineered mice, worms, flies, or zebrafish.

Cells suitable for use with the methods described herein can be any cell having a cell membrane. In certain embodiments, a cell system can be used to express VGP in a cell so as to monitor the activity of the VGP using any of the methods described herein. Cells suitable for use with the methods described herein can be primary cells, cultured cells, established cells, normal cells, transformed cells, tumor cells, infected cells, proliferating, terminally differentiated cells or any combination thereof.

Suitable cells include, but are not limited to bacterial (Gram-positive or Gram-negative), archeabacterial, eukaryotic, prokaryotic, fungal, insect, avian, reptilian, oocyte, fly, zebrafish, nematode, fish, amphibian, or mammalian cells. The certain embodiments, cells suitable for use with the methods described herein include, but are not limited to mammalian cell lines (e.g. COS, CHO, HeLa, NIH3T3, HEK 293-T and PC12), amphibian cells (e.g., *Xenopus* embryos and oocytes), insect cells (e.g. *D. melanogaster* cells), yeast cells (e.g., *S. cerevisiae, S. pombe*, or *Pichia pastoris*), and prokaryotic cells (e.g. *E. coli*). In one embodiment, the cell can be a *Xenopus* oocyte. The cells suitable for use with the methods described herein can be from any species, including, but not limited to, human cells, mouse cells, rat cells, dog cells, pig cells, or Chinese hamster ovary cells. Other examples of types of cells suitable for use with the methods described herein, include, but are not limited to include immune system cells (e.g., B-cells, T-cells), oocytes, red blood cells, white blood cells, neuronal cells, epithelial, glia, fibroblast, cancer cells, and immortalized cells. Examples of neuronal cells suitable for use with the methods described herein include, but are not limited to, squid axon, cerebellar Purkinje cells, neocortical pyramidal cells, thalamic neurons, CA1 hippocampal pyramidal cells, striatal neurons and mammalian CNS axons.

Examples of cell lines suitable for use with the methods described herein include, but are not limited to 293-T cells, 3T3 cells, 721 cells, 9L cells, A2780 cells, A2780ADR cells, A2780cis cells, A172 cells, A20 cells, A253 cells, A431 cells, A-549 cells, ALC cells, B16 cells, B35 cells, BCP-1 cells, BEAS-2B cells, bEnd.3 cells, BHK-21 cells, BR 293 cells, BxPC3 cells, C2C12 cells, C3H-10T1/2 cells, C6/36 cells, Cal-27 cells, CHO cells, COR-L23 cells, COR-L23/CPR cells, COR-L23/5010 cells, COR-L23/R23 cells, COS-7 cells, COV-434 cells, CML T1 cells, CMT cells, CT26 cells, D17 cells, DH82 cells, DU145 cells, DuCaP cells, EL4 cells, EM2 cells, EM3 cells, EMT6/AR1 cells, EMT6/AR10.0 cells, FM3 cells, H1299 cells, H69 cells, HB54 cells, HB55 cells, HCA2 cells, HEK-293 cells, HeLa cells, Hepa1c1c7 cells, HL-60 cells, HMEC cells, HT-29 cells, Jurkat cells, J558L cells, JY cells, K562 cells, Ku812 cells, KCL22 cells, KG1 cells, KYO1 cells, LNCap cells, Ma-Mel 1, 2, 3 . . . 48 cells, MC-38 cells, MCF-7 cells, MCF-10A cells, MDA-MB-231 cells, MDA-MB-468 cells, MDA-MB-435 cells, MDCK II cells, MDCK II cells, MG63 cells, MOR/0.2R cells, MONO-MAC 6 cells, MRCS cells, MTD-1A cells, MyEnd cells, NCI-H69/CPR cells, NCI-H69/LX10 cells, NCI-H69/LX20 cells, NCI-H69/LX4 cells, NIH-3T3 cells, NALM-1 cells, NW-145 cells, OPCN/OPCT cells, Peer cells, PNT-1A/PNT 2 cells, Raji cells, RBL cells, RenCa cells, RIN-5F cells, RMA/RMAS cells, Saos-2 cells, Sf-9 cells, SiHa cells, SkBr3 cells, T2 cells, T-47D cells, T84 cells, THP1 cells, U373 cells, U87 cells, U937 cells, VCaP cells, Vero cells, WM39 cells, WT-49 cells, X63 cells, YAC-1 cells, and YAR cells.

In certain embodiments, the cells suitable for use with the methods described herein will be cells that are transiently or stably transfected with a VGP. Expression of a VGP in a cell according to the methods described herein can be driven by any method known in the art, including the use of constitutive, tissue-specific, cell-specific or inducible promoter element(s), enhancer element(s) or both. VGP that can be expressed in a cell in accordance with the methods described herein can be any VGP described herein.

For recombinant expression of one or more of the VGP described herein, the nucleic acid containing all or a portion of the nucleotide sequence encoding the VGP can be inserted into an appropriate expression vector, i.e., a vector that contains the necessary elements for the transcription and translation of the inserted protein coding sequence. The necessary transcriptional and translational signals can also be supplied by the native promoter of the component protein gene, and/or flanking regions (Protein Expression. A Practical Approach (Higgins and Hames eds., Oxford University Press, 1999); Fernandez and Hoeffler, Gene Expression Systems. Using Nature for the Art of Expression (Academic Press, 1999); and Rai & Padh, Current Science 80(9):1121-1128, (2001).

The methods described herein can also be used to monitor the activity of an ion channel in a non-cell material, such as for example, an artificial membrane, a liposome, a phospholipid bilayer, and the like. Methods for introducing VGPs into artificial membrane, liposomes and phospholipid bilayers are known in the art and can be used in conjunction with the methods described herein.

In certain embodiments, co-expression of an inward rectifier channel can be used in conjunction with the methods described herein to control intracellular ion concentrations thereby allowing manipulation of membrane potential and to drive fractional inactivation of a VGIC under investigation.

In certain embodiments, the methods described herein can comprise measuring changes in VGP conductance by expressing a test VGP in a cell, a cellular fraction, an artificial membrane. Methods for measuring changes in VGP conductance can comprise steps of stimulating or inhibiting conduction through one or more pores of a the VGP and/or correlating changes in experimental conditions with changes in transmembrane conductance or membrane potential. In certain embodiments, measurements can be compared to conductance measurements obtained in control or blank measurements.

The VGP described herein can be tested in any type of membrane known in the art, including, but not limited to, a membrane from an intact cells, a membrane from a cellular fraction or an artificial membrane. Examples of membranes from intact cells suitable for use with the methods described herein include, but are not limited to, oocyte membranes or cell line membranes. Examples of membranes from cellular fractions suitable for use with the methods described herein include, but are not limited to, membranes from luminal organelles such as nuclei, ribosomes, mitochondria, endoplasmic reticulum, Golgi apparatus, vacuoles, synaptic vesicles, and lysosomes. Examples of artificial membranes suitable for use with the methods described herein include, but are not limited to, phospholipid micelles, liposomes, micro- and nanocapsules, and semi-liquid films on supportive structures.

Screening Methods and Compound Libraries

In certain aspects, the invention relates to methods useful for identifying compounds which are capable of modifying the ion permeability of VGICs that exhibits an ion leak when the VGIC is in a closed or inactive conformation. In certain aspects, the invention relates to methods useful for identifying compounds which are capable of modifying activity of a VSP. Generally, test compounds are selected if they can alter the activity of a VGP (e.g., inhibit or reduce an ion leak when a mutant VGICs are in a closed or inactive conformation to a state or condition or level comparable to a wild-type or normal VGIC)

Examples of such compounds include, but are not limited to, small organic molecules including pharmaceutically acceptable molecules. Examples of small molecules include, but are not limited to, polypeptides, peptidomimetics, amino acids, amino acid analogs, nucleic acids, nucleic acid analogs, nucleotides, nucleotide analogs, organic or inorganic compounds (i.e., including heteroorganic and organometallic compounds) having a molecular weight of less than about 10,000 grams per mole, salts, esters, and other pharmaceutically acceptable forms of such compounds. Examples of other compounds that can be tested in the methods of this invention include polypeptides, antibodies, nucleic acids, and nucleic acid analogs, natural products and carbohydrates. In certain embodiments, compounds suitable for testing with the methods described herein can be from a peptide library, a phase display library, or from a library of known and/or previously characterized compounds.

A compound can have a known chemical structure but not necessarily have a known function or biological activity. Compounds can also have unidentified structures or be mixtures of unknown compounds, for example from crude biological samples such as plant extracts. Large numbers of compounds can be randomly screened from chemical libraries, or collections of purified chemical compounds or collections of crude extracts from various sources. The chemical libraries can contain compounds that were chemically synthesized or purified from natural products. Methods of introducing test compounds to cells are well known in the art.

Those having ordinary skill in the art will appreciate that a diverse assortment of compound libraries can be prepared according to established procedures, and tested for their influence VGIC function. The test compounds can be obtained using any of the numerous approaches in combinatorial library methods known in the art (see Lam K S, Anticancer Drug Des. 12:145-67 (1997)). Such compound libraries are also available from commercial sources such as ComGenex (U.S. Headquarters, South San Francisco, Calif.), Maybridge (Cornwall, UK), and SPECS (Rijswijk, Netherlands), ArQule, Tripos/PanLabs, ChemDesign and Pharmacopoeia. The compounds identified in the screening methods of this invention can be novel or can be novel analogs or derivatives of known therapeutic compounds.

Assays for detecting, isolating and characterizing protein complexes are well known in the art (e.g., immunoassays, activity assays, mass-spectrometry) and can be used to determine whether one or more compounds described herein bind to a VGP. Methods for screening for a molecule that binds a VGIC can be performed using cell-free and cell-based methods known in the art (e.g. in vitro methods, in vivo methods or ex vivo methods). For example, an isolated VGP or VGP complex can be employed, or a cell can be contacted with the candidate molecule and the complex can be isolated from such contacted cells and the isolated complex can be assayed for activity or component composition. Methods for screening can involve labeling the component proteins of the complex with, for example, radioligands, fluorescent ligands or enzyme ligands. VGPs can be isolated by any technique known in the art, including but not restricted to, co-immunoprecipitation, immunoaffinity chromatography, size exclusion chromatography, and gradient density centrifugation.

The following examples illustrate the present invention, and are set forth to aid in the understanding of the invention, and should not be construed to limit in any way the scope of the invention as defined in the claims which follow thereafter.

EXAMPLES

Example 1: Subcloning of cDNA Constructs cDNA plasmids encoding VGICs will be subcloned into appropriate vectors suitable for the generation of stable cell pools and stable cell lines. In certain embodiments, the pIRESpuro3 vector will be used for high, uniform expression in antibiotic resistant, stable pools to support electrophysiological characterization of Kv2.1 wild-type and mutant channels. The mutant VGICs used will include "wild-type" Kv2.1, Kv2.1 R300S mutant, and Kv2.1 R294C/R300S double mutant. All Kv2.1 constructs contain a set of mutations (T355S, K356G, A362D, S363A, I379M, Y380T, and K382V) in the channel's "turret region" that enables blockade of the central pore current by turret-selective (and pore-blocking) toxins, e.g., agitoxins.

Example 2: Generation of Wild-Type and Mutant Kv2.1 Stable Cell Pools, and Initial Evaluation of Central Pore Currents Antibiotic-resistant stable cell pools from each Kv2.1 cDNA will be generated. Electrophysiological characterization of expression of each cell pool (the channel's central pore current) will be performed on IonWorks. The central pore current of each pool will be measured and characterized to determine I/V, G/V, and selectivity.

In certain embodiments, multiple transfections will be employed to obtain sufficiently high expression levels. Validation of cDNA plasmid preparations can be performed by other methods, including, but not limited to, qPCR or oocyte expression studies.

A host parental cell line (CHO) will be evaluated for sensitivity to antibiotic selection and toxicity of cDNA constructs to determine optimal conditions for transfections. CHO cells will be transfected with multiple concentrations of cDNA encoding the VGICs described herein. Antibiotic-resistant stable cell pools will be isolated and expanded.

For characterization of central pore ionic currents via IonWorks, voltage-clamp recordings in the presence and absence of pore-blocking toxins (e.g., AgTx1, AgTx2, HgTx1, and/or ShK will be performed. The efficiency of toxin blocking will be determined with replicated protocols (e.g. minimum of 250 successful recordings; seal R>50 MΩ). These methods will demonstrate stable expression of each cDNA and characterize Kv2.1 central pore currents. The data will be used to compare effectiveness of about 2-4 different pore-blocking toxins and whether there is efficient blockade of Kv2.1 central pore currents (sub-nM affinity; sub-pS central pore current) by one or more pore-blocking toxins.

Example 3: Manual Electrophysiology and Pharmacological Evaluation of Central Pore and Gating Pore Currents Stable pools from each Kv2.1 cDNA will be used to evaluate the biophysical and pharmacological properties of wild-type and mutant Kv2.1 central pore and gating pore (leak) currents.

Manual voltage-clamp electrophysiology will be used to measure I/V and G/V relationships and selectivity for central pore current. Gating pore current pharmacology will be determined as a function of the relationship between I/V and G/V as well as the selectivity in the presence of central pore and gating modifying peptides.

These results will demonstrate Kv2.1 central pore I/V and G/V relationships and ion selectivity as well as Kv2.1 gating pore I/V and G/V relationships and gating pore ion selectivity. These results will also be used to determine whether there is a response, cessation of, or reduction in leak current in R294C, R300S and R300S Kv2.1 mutants exposed to cysteine-reactive reagents.

Example 4: IonWorks Automated Patch Clamp Electrophysiology and Pharmacological Evaluation of Central Pore and Gating Pore Currents Stable pools from each Kv2.1 cDNA will be used to evaluate the biophysical and pharmacological properties of wild-type and mutant Kv2.1 central pore and gating pore (leak) currents.

IonWorks automated patch clamp electrophysiology will be used to measure I/V and G/V relationships and selectivity for central pore current. Gating pore current pharmacology will be determined as a function of the relationship between I/V and G/V as well as the selectivity in the presence of central pore and gating modifying peptides.

These results will demonstrate Kv2.1 central pore I/V and G/V relationships and ion selectivity as well as Kv2.1 gating pore I/V and G/V relationships and gating pore ion selectivity. These results will also be used to determine whether there is a response, cessation of, or reduction in leak current in R294C, R300S and R300S Kv2.1 mutants exposed to cysteine-reactive reagents.

Example 5: Additional Experiments on the R294C, R300S Mutant Kv2.1 Cell Pool, Along with Control Experiments on the R300S Mutant Kv2.1 Cell Pool Blockade of gating pore currents will be measured in the presence and absence of cationic and anionic, membrane-impermeable cysteine-reactive reagents that react from the extracellular side of a membrane.

Example 6: Treating Voltage Sensing Domain Channelopathies

Resting state-specific voltage sensing domain leak current blockers (e.g. small molecule or modified toxin) will be used to assay the function of VGICs that exhibit leak currents. The assay will be used to identify compounds suitable for treated VGIC related channelopathies including, but not limited to autoimmune diseases (using a Kv1.3 blocker that targets the pore domain), and Treat type 2 diabetes (using a Kv2.1 blocker that targets the pore or the voltage sensing domain).

The method will be validated by targeting the KV2.1 voltage sensing domain. Validation will be performed by monitoring resting state leak currents in wild type Kv2.1 and Kv2.1 comprising S4 helix mutations in the voltage sensing domain. Leak currents will be blocked by selectively targeting the resting state of the VGIC using cysteine-tethered reagents, voltage sensing domain toxins and small molecule library screening. These results will confirm that targeting and blocking the voltage sensing domain of VGICs is a valid therapeutic approach for the treatment of channelopathies.

The methods described herein can be performed on any VGIC. In certain embodiments, the methods will involve a step of introducing a leak inducing mutation into a VGIC (e.g. an S4 mutation). In certain embodiments, the methods will involve a step of blocking main pore ionic current (e.g. tetrodotoxin for Nav channels). In certain embodiments, the methods will involve a step of demonstrate that voltage sensing domain mutant exhibits a leak current. In certain embodiments, the methods will involve a step of screening compound library (small molecules or biologics) for compounds capable of modulating of leak current in mutated VGICs that exhibit a leak current.

Example 7: Mechanism of Voltage Gating in K+ Channels

The mechanism of ion channel "voltage gating"—how channels open and close in response to voltage changes—has been debated since Hodgkin and Huxley's seminal discovery that the crux of nerve conduction is ion flow across cellular membranes. Using all-atom molecular dynamics simulations, shown herein is how a voltage-gated $K^+$ channel switches between activated and deactivated states. On deactivation, pore hydrophobic collapse rapidly halts ion flow. Subsequent voltage-sensing domain (VSD) relaxation, including inward, 15-Å S4-helix motion, completes the transition. On activation, outward S4 motion tightens the VSD-pore linker, perturbing linker-S6-helix packing. Fluctuations allow water, then $K^+$, to re-enter the pore; linker-S6 repacking stabilizes the open pore. The results described herein show a mechanistic model for the $Na^+/K^+/Ca^{2+}$ voltage-gated channel superfamily that reconciles apparently conflicting experimental data.

Hodgkin and Huxley discovered that voltage-regulated ion flow underlies nerve conduction (1). Only decades later were voltage-sensing domains (VSDs) identified as controlling the activity of voltage-gated K+, Na+, and Ca2+ channels (2-4), shifting these proteins between activated and deactivated states in response to changes in transmembrane voltage (5-7). Different mechanistic models have been proposed to describe how conserved arginine and lysine "gating charge" residues on a VSD transmembrane helix (S4) couple with the electric field to gate ion channel conduction (8-10). Some experiments suggest substantial S4 motion during gating (11), others far less (12). Also unresolved has been whether S4 moves through a largely static electric field, or whether the VSD instead reshapes the field around S4 during gating. Even less clear has been how S4 triggers the attached channel pore domain to gate conduction. Finally, it has been unknown whether other motions, either subtle or large-scale, are involved in voltage gating (6, 13), largely because, unlike the open state, no crystal structure of a fully deactivated, closed-state voltage-gated channel exists.

To study the voltage-gated transition at the atomic level, we subjected the open conformation of the KV1.2/KV2.1 "paddle chimera" (10, 14) voltage-gated K+ channel to molecular dynamics (MD) simulations at both hyperpolarizing (V<0 mV) and depolarizing (V>0 mV) voltages over experimentally determined channel-gating timescales. Our all-atom system comprises the channel, either with ("T1+") or without ("T1−") the modulatory, but functionally nonessential cytoplasmic T1 domain (15,16), in a symmetric, neutral phospholipid bilayer [omitting modulatory, negatively charged lipids (17)], hydrated with 0.5 M KCl (18). The simulations were performed using a special-purpose machine designed for high-speed MD simulations (19).

At depolarizing control voltages, the (T1−) channel exhibited, steady outward conduction through a fully hydrated pore cavity (FIG. 16a, c and inset); K+ current and H2O/K+ permeation ratio (~1) broadly agree with experiment (20) and pore domain—only simulations (21). No significant conformational changes or gating charge displacement occurred, indicating that the paddle chimera crystal structure (10) embodies a fully activated, open state.

Figure 17A:
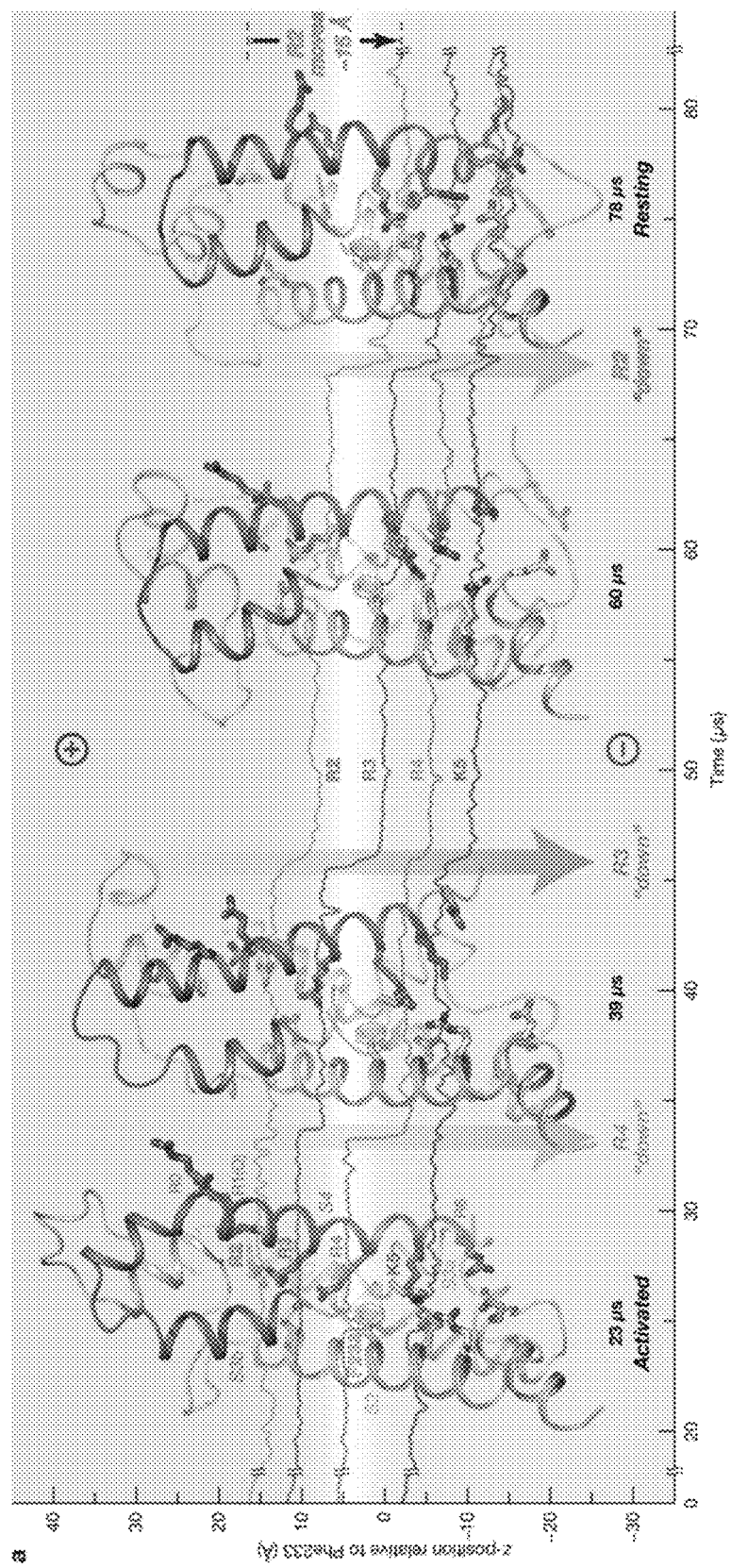

In marked contrast, at hyperpolarizing voltages the channel went from an open, inwardly conducting state to a closed, non-conducting state—the resting state. The channel exhibited a transient inward "tail" current, but conduction halted upon water leaving the hydrophobic pore cavity ("dewetting") and concurrent pore closure ("cavity collapse") at ~20 μs (FIG. 16b, d and inset); the observed dewetting, as also seen in pore-only simulations (21), explains the osmotic sensitivity of the overall gating process (21, 22). Subsequent inward S4 translation and lateral loosening of the VSDs from the pore domain completed the transition over ~100-200 μs (FIG. 17). Overall, the gating transition thus consists of the channel moving from a VSD-"up," VSD-pore apposed conformation to a VSD-"down," VSD-pore loosened conformation (FIG. 16). The T1$^+$ resting state exhibited less VSD-pore separation than T1.

Figure 27:
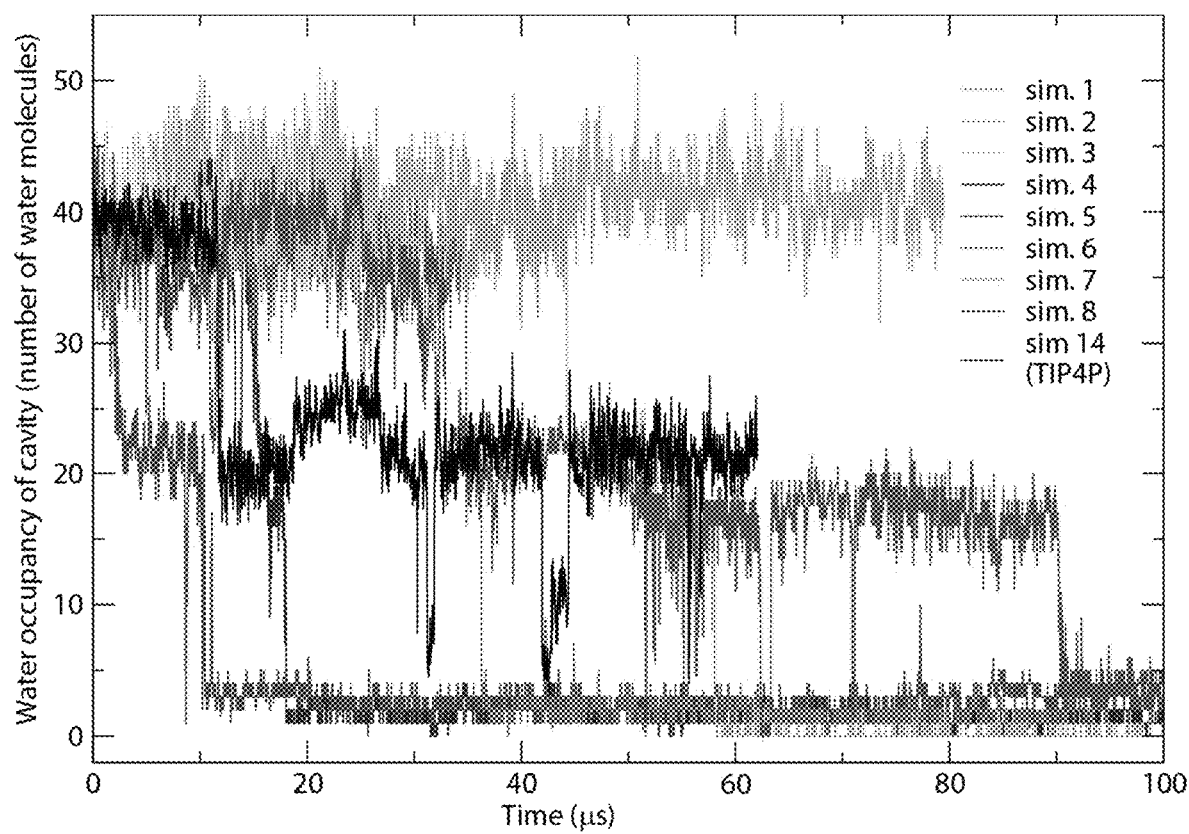
FIG. 27 shows water occupancy of the pore cavity. The water occupancy is shown as a function of time for simulations 1-8 and 14 [see FIG. 21]. A fully hydrated cavity holds about 40 water molecules.
Figure 28:
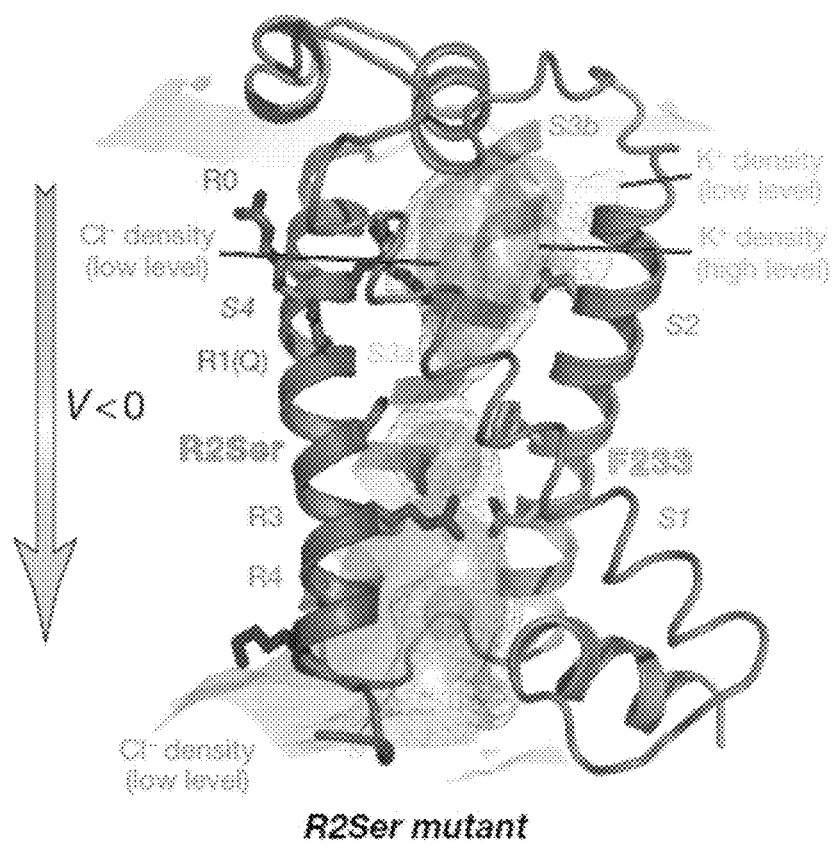
FIG. 28 shows Ion selectivity in the "omega" pore. In this resting-state conformation of the R2Ser mutant voltage sensing domain (VSD) the cation permeation pathway—the omega pore—is shown as a grey mesh; the green surface indicates high-occupancy "sites" during K+ permeation through the omega pore. The discontinuous purple surfaces represent Cl- density, obtained from the same simulation. The Cl- density, which is contoured at the same level as the continuous K+ density (grey mesh), indicates no anion permeation across the VSD center.

The activated state VSDs delay channel closure by preventing pore hydrophobic collapse into the intrinsically more stable closed state (19, 21). The activated-state VSDs delay channel closure by preventing pore hydrophobic collapse into the intrinsically more stable closed state (21, 23). The time at which pore closure occurred (determined by the pore cavity hydration level) and the tail current persistence time observed here, both ~20 μs, are in line with the 20 μs experimental tail current time constant [temperature-corrected Shaker data (18, 24); see FIG. 23]. This closure time is, however, ~10-fold longer than what was found in pore domain—only simulations (21), indicative of a VSD-imposed delay of the closure. A control simulation with a different water model (18) also exhibited dewetting, after ~30 μs, with little gating charge transfer prior to dewetting (FIG. 27). The ~100-200 μs taken to complete the activated-to-resting transition—including full gating charge displacement and VSD relaxation (FIG. 17)—is also in line with the experimental value of ~300 μs observed for the slow off-gating component (25).

The S4 helix—bearing gating-charge residues R1 (neutral Gln in the chimera; "R1(Q)"), R2, R3, R4, and K5—is the main VSD moving part S4 translated ~15 Å overall across the membrane while rotating ~120°, moving in a groove formed by the largely stationary S1-S3a helices (FIG. 17). S3b, while more mobile than S1-S3a, did not translate inward to a notable extent. R4—centrally located in the activated state at the point of strongest transmembrane electric field (FIG. 17c, inset)—initiated gating-charge movement; Phe233, a central hydrophobic residue, separated the VSD extracellular and intracellular hydrated lumens throughout. R3 and R2 moved in turn, and inward S4 motion typically stopped when R1(Q) reached Phe233. These observations support a recent gating model that emphasizes sequential motion of S4 arginine residues past Phe233 (26).

As the gating-charge residues filed past Phe233, their side chains faced the VSD lumens, not the membrane hydrophobic core; transient salt bridges formed by these gating-charge residues with acidic residues on S1 and S2 and with lipid negatively charged phosphodiester groups facilitated the transition. Relative to the activated state, the resting state had fewer intra-VSD salt bridges but more S4-phosphate interactions (FIG. 25). The results described herein show that VSD-phosphodiester group interactions are functionally critical, whereas anionic lipids are modulatory, perhaps by interacting with gating charges or the T1 domain (17, 27).

In line with experimental gating charge values of 12-14 e (28), the complete transition into the fully relaxed state—all four VSDs "down" with all the gating-charge residues (R2-R4) inward of Phe233—yielded a calculated gating charge of 13.3±0.4 e (FIG. 17c and FIG. 21). This VSD-gating charge was solely accounted for by the ~15-Å translation of the S4 helices through an electric field, focused over ~15 Å, that was found to be similar in activated and resting VSD conformations (FIG. 17c, inset). The results described herein show that limited motion of a single VSD (S4) toward the resting state suffices to close the pore. Charge displacements tied to early S4 motion—typically ~1-7 e with at least one R4 inward of Phe233 (FIG. 17c)—preceded pore closure, yet the pore always closed before all four VSDs were fully down. Experimentally, it is known that ~25% charge displacement suffices to close the channel (29).

Initial S4 inward motion disrupted the extracellular VSD-pore domain interface, resulting in domain separation: ~14 Å for T1 and ~5 Å for T1$^+$, measured as the R1(Q)-Ala351 distance parallel to the membrane plane. VSD-pore separation contributed to a whole-protein root-mean-squared deviation (RMSD) of >14 Å ($C_a$ atoms; relative to the X-ray structure) for the T1 resting state and ~9 Å for that of T1$^+$ (FIG. 17d); the linker between the T1 domain and the VSD—an additional constraint not present in T1$^−$—serves to reduce T1$^+$ VSD mobility within the membrane plane. By contrast, the tetrameric pore domain exhibited, relative to the open-state crystal structure, only a modest ~3-Å RMSD increase, due to pore closure at ~20-30 μs. Translation of S4 alone, or as the main moving part of the S3b-S4 paddle, resulted in large, >10-Å RMSDs for S4 relative to the mostly stationary S1-S3a helices (RMSD<3 Å).

Additional simulations revealed the major steps of channel activation (simulations 9-13, FIG. 21). The first (re)activation step of the resting-to-activated transition was examined by subjecting the T1$^+$ resting state, obtained above (simulation 9), to depolarizing voltages. Experimentally, T1$^+$ channels activate faster than T1 deletion mutant channels (16), presumably due to restraint of VSD mobility by the T1 domain.

Upon depolarization, helix S4 immediately moved ~7 Å outward, transferring ~50% of the total gating charge in ~75 μs (FIG. 18a, b). Initially, gating-charge transfer is fast because most salt bridges between S4 and the rest of the VSD are disrupted in the resting state; as S4 moved outward, these salt bridges began transiently to re-form, leading to a gradual slowing of S4 motion and gating-charge transfer. As S4 movement neared completion the VSDs re-approached the activated state (FIG. 18a, see also FIG. 17). Experimentally, gating-charge transfer must be complete, in all four subunits, for the pore to open (8, 28). In line with these experimental observations, full S4 outward movement (and gating-charge transfer) in one or two VSDs was insufficient to open the pore in the simulations described herein (FIG. 21).

The second reactivation step—the final cooperative transition (6, 7, 13) to the open state—was examined by starting from a T1$^−$ configuration in which all VSDs, save one, were "up" (S4 helices fully outward), but for which the pore remained fully or partially closed (The "partially closed" pore cavity contains ~20 water molecules; FIG. 21, simulations 10-12. The fully closed state resembles that observed in Na$_x$Ab (32)). These simulations, at depolarizing voltages, led to a fully activated and conducting state within a few tens of microseconds (FIG. 18c-h).

Experiments have shown that a single, cooperative transition precedes conduction; this final transition, which contributes only ~5% of total gating charge, occurs after all VSDs have moved fully up (8). In the simulations described herein, little or no additional gating-charge transfer occurred after the final outward motion of the S4 helix brought the S4-S5 linker into a tense conformation (FIG. 21). This final motion perturbed the packing between the S4-S5 linker and the S6 helix (FIG. 18f, g), leading to packing fluctuations, as shown by the linker-S6 interaction energies in FIG. 18f. This weakened and fluctuating packing enabled partial pore opening and rapid partial rehydration—water molecules re-entered the pore cavity in less than one, µs—allowing subsequent $K^+$ entry and initial slow, outward conduction (FIG. 18c-e).

The partially open, partially hydrated, and slowly conducting pore persisted for a few microseconds before reaching the fully conducting state (FIG. 18c, e). The presence of ions in the cavity, which subsequently were driven outward through the selectivity filter (SF) by the depolarizing voltage, further increased pore rehydration (FIG. 18c, d). As the hydrostatic pressure within the cavity thereby increased, the lower gate, at the pore "PVP" motif, fully opened, with the Leu331 (S5) and Pro405 (S6) side-chains interchanging positions (21). This interchange caused S6 to kink at the PVP motif, widening the cavity and allowing it to finally become fully hydrated (FIG. 18c). Concurrent opening of the upper (hydrophobic) gate, at Ile402 (FIG. 18h), enabled SF site S5 to become populated with $K^+$, thus increasing the cavity ion occupancy by one (FIG. 18d, e). $K^+$ presence in S5 allowed formation of the critical "knock-on" conduction mechanism intermediate, (S5,[S4,S2]; FIG. 18e; 21), causing the channel to assume a fully conducting state (20.7±2.7 pA; FIG. 18c, e). Early conduction occasionally slowed as Leu331 and Pro405 transiently back-interchanged; after the final Leu331/Pro405 interchange took place, however, S6 and the S4-S5 linker settled into a closely packed configuration that stabilized the open pore, and thus the activated, conducting state (FIG. 18c, f, g).

Interaction of the S4-S5 linker and helix S6 is central to gating. In $K_v1.5$, pairs of interacting linker and C-terminal S6 residues have been identified (33). Mapped onto $K_v1.2$, these functionally important interactions are between residues [Ile316, Thr320] (linker) and [Asn412, Phe413, Phe416, Tyr417] (S6). These pairs, and linker residue Ala323, all stand out in residue contact maps (FIG. 18g), highlighting linker-S6 interaction as central to activation. Substitution of the $K_v2.1$ linker and S6 C-terminus into $K_v1.5$, moreover, has been shown to confer $K_v2.1$ activation and deactivation kinetics to this $K_v1.5$ chimera, while preserving $K_v1.5$ voltage dependency (33). Thus, the results described herein show that the linker and S6 C-terminus together ultimately govern pore gating, independent of the VSD structural machinery that moves up or down during voltage sensing, irrespective of the details of the VSD structural machinery that moves up or down during voltage sensing, The results described herein show the mechanistic model for $K^+$ channel voltage-gating shown in FIG. 19. This model integrates analysis of atomic-level observations of both the activated-to-resting-state gating transitions and the complementary steps of the reverse resting-to-activated-state gating transition presented above (FIG. 21). This model shows that voltage-gated $K^+$ channel opening requires the motion of four independent membrane-bound charged "particles," while channel closing requires the motion of only one.

Figure 19:
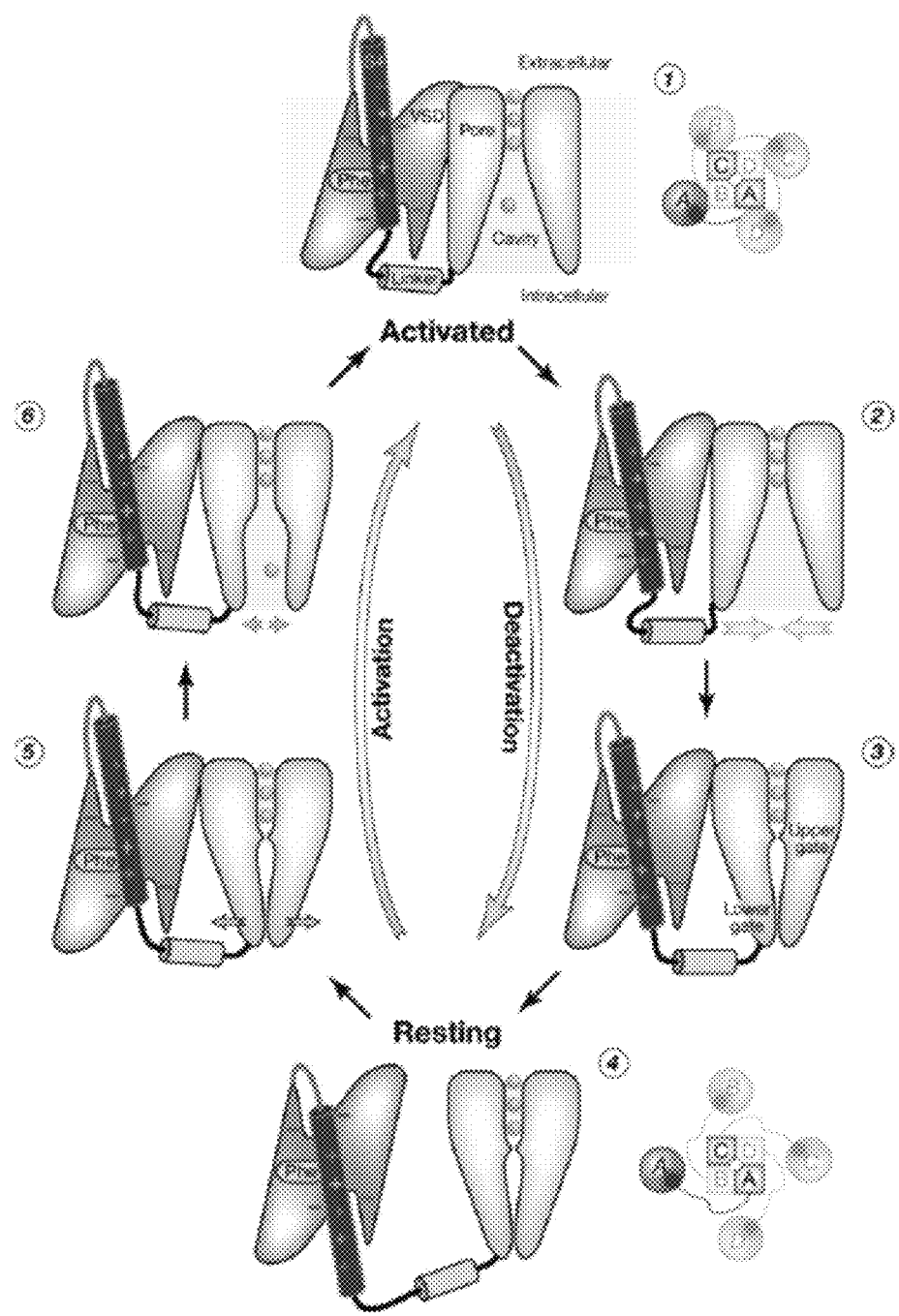
FIG. 19 shows a mechanistic model for voltage gating. Subjecting the activated state (1) to hyperpolarizing voltage initiates S4 inward movement and VSD-pore lateral separation. Ion depletion of the pore cavity (2)—coupled to inward motion of a single S4—leads to pore hydrophobic collapse: closure of the upper (Ile402) and lower gates [PVP motif; Leu331 (S5)-Pro405 (S6) side-chain interchange (M. Ø. Jensen et al., (2010) Principles of conduction and hydrophobic gating in K+ channels. Proc. Natl. Acad. Sci. USA 107:5833-5838)] halts conduction (3). S4 continues inward and VSD-pore separation increases; as S4 completes its inward motion, the S4-S5 linker helix moves fully down and the VSDs separate from the pore, consolidating the resting state (4). Subjecting the resting state to depolarizing voltage drives S4 outward. When all four S4 and S4-S5 linker helices are fully up (5), and all VSDs have repacked against the pore, the lower gate becomes destabilized; the 4→5 transition constitutes the rate-limiting step in the activation process. Lower gate fluctuation triggers pore opening and partial pore rehydration—water molecules cooperatively enter the cavity—that allow ion entry and initial outward conduction (6); the 5→6 transition is essentially voltage-independent. The presence of ions drives complete pore rehydration, which in turn fully opens the upper and lower gates and, again in an essentially voltage-independent manner, returns the channel to its activated state (1). The lateral position of the VSDs (circles) relative to the pore domain (squares) is shown schematically (extracellular view).
Figure 24B:
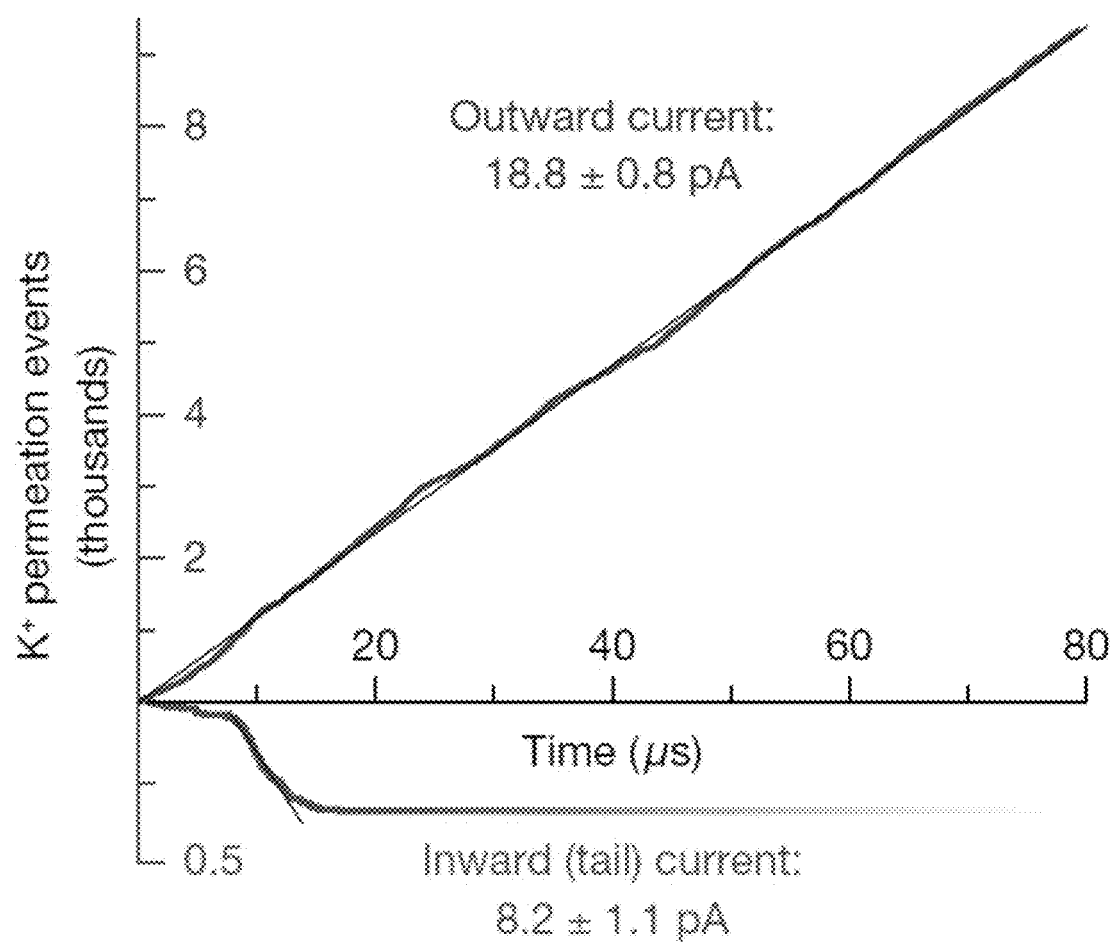
Figure 26:
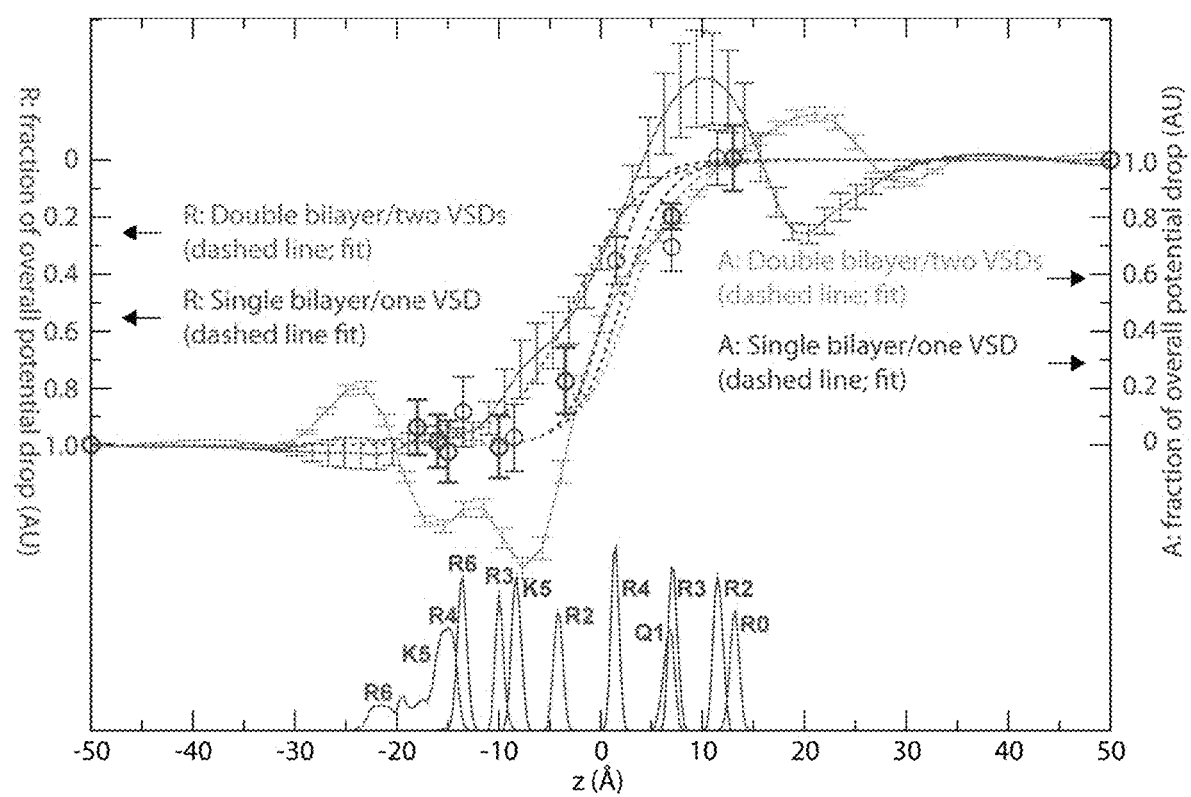
FIG. 26 shows potential drop across the voltage-sensing domain. Potential drops are depicted as a fraction of the total potential drop (V) for activated ("A") and resting ("R") state conformations of the voltage-sensing domain. Potentials were obtained from free energy calculations with a single sensor in a single bilayer, where V was imposed through a constant electric field, and from double bilayer simulations with two anti-parallel-oriented VSDs, one in each bilayer, where V was imposed through charge imbalance [see FIG. 27]; AU, arbitrary units. Only data for one VSD from the double bilayer simulations are shown; the data for the other VSD are the same within error. The fractional potential drop, f(z), was fit to $f(z)=1/[\exp(-c(z-z'))+1]$. For both states, the constant electric field and the charge imbalance methods give similar results. Notably, the field is strongest at R4, in accord with the observations of the gating process described herein: R4 is always the first S4 arginine to move inward. The positional distributions (of Arg C$_\zeta$ and Lys N$_\zeta$) from the equilibrium simulation of a single VSD are shown for reference.

Beginning with the activated state (FIG. 19, state 1), ion depletion, hydrophobic dewetting, and closure of the pore cavity, with concurrent early gating-charge inward movement, halt ionic conduction. Subsequent full VSD relaxation—inward S4 translation by ~15 Å relative to a largely rigid S1-S3a VSD core coupled with ~120° S4 rotation (FIG. 17b) that keeps the gating-charge residues pointed toward the VSD lumens, and lateral VSD-pore separation due to VSD rotation and translation relative to the pore—permits the pore to remain closed (FIG. 19, state 4). Translation of S4 gating-charge residues accounts for the gating charge. Channel activation reverses these steps. The key difference is that all four VSDs must be "up" before the closed pore can reopen; a fully outward S4 perturbs the S4-S5 linker/S6 packing, thereby allowing water, and hence ion, re-entry and subsequent conduction, stabilized by linker/S6 repacking.

The gating mechanism and resting-state structure described herein reconcile the many apparently conflicting measures of voltage-gated $K^+$ channel conformation (FIGS. 16, 17, and 18). Given natural sequence variability in functionally critical regions (S3b-S4 paddle; and the interacting S4-S5 linker and S6), certain details of gating likely vary between channels, including between wild-type $K_v1.2$ and the $K_v1.2/K_v2.1$ chimera that we used in our simulations. Yet, the fact that the S3b-S4 paddle can be swapped between channels to yield chimeras that retain voltage-gating function (35, 36) shows that the key mechanistic aspects are broadly shared across the voltage-gated ion channel superfamily The results described herein show that channel opening and closing are energetically asymmetric processes. Since the intrinsically most stable state of the pore in isolation is dewetted and closed (21, 23), due to the hydrophobic lining of the pore cavity (21), S4 need not actively "push" the S4-S5 linker down to close the pore. Channel activation does, however, require depolarization-driven work—the forcing of S4 back across the membrane—ultimately to ultimately "pull" the S4-S5 linker tight, which perturbs its interaction with S6, leading to pore opening. Only when all gating-charge residues and S4-S5 linkers are fully "up" does the closed pore become sufficiently destabilized that fluctuations of the lower gate, through perturbed linker-S6 packing, allow partial and then—as the last conformational transition during activation—complete cavity rewetting (FIG. 19).

The S4-S5 linker is tense in the activated state but relaxed in the resting state, perhaps explaining conservation of linker length: a shorter linker would inhibit channel closing, as S4 could not translate inward far enough, and a longer linker would inhibit opening, as even full S4 outward translation could not lead to an effective pull on the pore through the linker.

The atomic-level determination of the resting state conformation described herein can be useful in guiding the development of drugs to treat those human channelopathies associated with the resting state (37). VSDs normally are impermeable to ions, but certain inherited S4 gating-charge mutations permit abnormal cation conduction through resting state "omega pores" (38), leading to, for example, cardiac long-QT syndromes, various paralyses, and migraine (37, 39-40). VSD residues accessible from the intracellular and extracellular sides (41, 42) and residues thought to line the omega pore (43) map well onto the resting-state conformation described herein (FIG. 20a). This resting-state VSD should thus exhibit omega currents, once an S4 gating-charge residue is appropriately mutated to a smaller, polar, uncharged residue (37, 44, 45). Such mutation of Shaker R1 to histidine or serine permits $H^+$ or alkali cation and guanidinium currents (38, 46).

The R2Ser mutation (37) was introduced into the resting state conformation [R2-R4 down, (19, 38)]. The mutant VSD exhibited significant inward $K^+$ current (no $Cl^-$ current). This current arises because apposition of Phe233 with the mutated residue, which lacks the large, positive guanidinium group of the gating-charge residues, leads to increased hydration of the VSD hydrophobic constriction and thereby permits permeation of cations (FIG. 20b, c). Depolarization halted the current and transferred ~2 e of gating charge (FIG. 23)

The transition into the resting state, as well as the conformation of the state itself, demonstrates that the VSD omega and gating-permeation pathways are one and the same. Mutation of gating-charge residues enables pathological cation leaks through the VSD along the identical pathway taken by the physiological gating-charge guanidinium groups. We thus provide a structural explanation for hyperpolarization-induced (as well as depolarization-induced) cationic leak currents associated with channelopathies in certain human voltage-gated ion channels.

REFERENCES

1. A. L. Hodgkin, A. F. Huxley, A quantitative description of membrane current and its application to conduction and excitation in nerve. J. Physiol. 117, 500-544 (1952).
2. M. Noda et al, Primary structure of Electrophorus electricus sodium channel deduced from cDNA sequence. Nature 312, 121-127 (1984).
3. B. L. Tempel, D. M. Papazian, T. L. Schwarz, Y. N. Jan, L. Y. Jan, Sequence of a probable potassium channel component encoded at Shaker locus of Drosophila. Science 237, 770-775 (1987).
4. R. D. Nelson, G. Kuan, M. H. Saier Jr., M. Montal, Modular assembly of voltage-gated channel proteins: A sequence analysis and phylogenetic study. J. Mol. Microbiol. Biotechnol. 1, 281-287 (1999).
5. F. Bezanilla, The voltage sensor in voltage-dependent ion channels. Physiol. Rev. 80, 555-592 (2000).
6. K. J. Swartz, Sensing voltage across lipid membranes. Nature 456, 891-897 (2008).
7. F. J. Sigworth, Structural biology: Life's transistors. Nature 423, 21-22 (2003).
8. N. E. Schoppa, K. McCormack, M. A. Tanouye, F. J. Sigworth, The size of gating charge in wild-type and mutant Shaker potassium channels. Science 255, 1712-1715 (1992).
9. S. K. Aggarwal, R. MacKinnon, Contribution of the S4 segment to gating charge in the Shaker K+ channel. Neuron 16, 1169-1177 (1996).
10. S. B. Long, X. Tao, E. B. Campbell, R. MacKinnon, Atomic structure of a voltage-dependent K+ channel in a lipid membrane-like environment. Nature 450, 376-382 (2007).
11. V. Ruta, J. Chen, R. MacKinnon, Calibrated measurement of gating-charge arginine displacement in the KvAP voltage-dependent K+ channel. Cell 123, 463-475 (2005).
12. M. M. Pathak, V. Yarov-Yarovoy, G. Agarwal, B. Roux, P. Barth, S. Kohout, F. Tombola, and E. Y. Isacoff, Closing In on the Resting State of the Shaker K+ Channel. Neuron 56, 124-140 (2007).
13. W. A. Catterall, Ion channel voltage sensors: Structure, function, and pathophysiology. Neuron 67, 915-928 (2010).
14. X. Tao, R. MacKinnon, Functional Analysis of Kv1.2 and Paddle Chimera Kv Channels in Planar Lipid Bilayers. J. Mol. Biol. 382, 24-33 (2008).
15. A. M. VanDongen, G. C. Frech, J. A. Drewe, R. H. Joho, A. M. Brown, Alteration and restoration of K+ channel function by deletions at the N- and C-termini. Neuron 5, 433-443 (1990).
16. W. R. Kobertz, C. Miller, K+ channels lacking the 'tetramerization' domain: implications for pore structure. Nat. Struct. Biol. 6, 1122-1125 (1999).
17. D. Schmidt Q.-X. Jiang, R. MacKinnon, Phospholipids and the origin of cationic gating charges in voltage sensors. Nature 444, 775-779 (2006).
18. Materials and methods are available as supporting material on Science Online.
19. D. E. Shaw et al, Millisecond-scale molecular dynamics simulations on Anton. Proc. Conf. High Performance Computing, Networking, Storage and Analysis (SC09) (ACM Press, New York, 2009).
20. H. Ando, M. Kuno, H. Shimizu, I. Muramatsu, S. Oiki, Coupled K+-water flux through the HERG potassium channel measured by an osmotic pulse method. J. Gen. Physiol. 126, 529-538 (2005).
21. M. Ø. Jensen et al, Principles of conduction and hydrophobic gating in K+ channels. Proc. Natl. Acad. Sci. USA 107, 5833-5838 (2010).
22. J. Zimmerberg, F. Bezanilla, V. A. Parsegian, Solute inaccessible aqueous volume changes during opening of the potassium channel of the squid giant axon. Biophys. J. 57, 1049-1064 (1990).
23. O. Yifrach, R. MacKinnon, Energetics of pore opening in a voltage-gated K+ channel. Cell 111, 231-239 (2002).
24. B. M. Rodriguez, F. Bezanilla, Transitions near the open state in Shaker K+-channel: Probing with temperature. Neuropharmacology 35, 775-785 (1996).
25. B. M. Rodriguez, D. Sigg, F. Bezanilla, Voltage gating of Shaker K+ channels. The effect of temperature on ionic and gating currents. J. Gen. Physiol. 112, 223-242 (1998).
26. X. Tao, A. Lee, W. Limapichat, D. A. Dougherty, R. MacKinnon, A gating charge transfer center in voltage sensors. Science 328, 67-73 (2010).
27. Y. Xu, Y. Ramu, Z. Lu, Removal of phospho-head groups of membrane lipids immobilizes voltage sensors of K+ channels. Nature 451, 826-829 (2008).
28. L. D. Islas, F. J. Sigworth, Voltage sensitivity and gating charge in Shaker and Shab family potassium channels. J. Gen. Physiol. 114, 723-741 (1999).
29. A. Loboda, C. M. Armstrong, Resolving the gating charge movement associated with late transitions in K channel activation. Biophys. J. 81, 905-916 (2001).
30. N. E. Schoppa, F. J. Sigworth, Activation of Shaker potassium channels. III. An activation gating model for wild-type and V2 mutant channels. J. Gen. Physiol. 111, 313-342 (1998).
31. J. L. Ledwell, R. W. Aldrich, Mutations in the S4 region isolate the final voltage-dependent cooperative step in potassium channel activation. J. Gen. Physiol. 113, 389-414 (1999).
32. J. Payandeh, T. Scheuer, N. Zheng, W. A. Catterall. Crystal structure of a voltage-gated sodium channel. Nature 475, 353-358 (2011).
33. A. J. Labro, A. L. Raes, A. Grottesi, D. Van Hoorick, M. S. P. Sansom, D. J. Snyders, K V channel gating requires a compatible S4-S5 linker and bottom part of S6, constrained by non-interacting residues. J. Gen. Physiol. 132, 667-680 (2008).

34. K. McCormack, M. A. Tanouye, L. E. Iverson, J. W. Lin M. Ramaswami, T. McCormack, J. T. Campanelli, M. K. Mathew, B. Rudy, A role for hydrophobic residues in the voltage-dependent gating of Shaker K+ channels. Proc. Natl. Acad. Sci. USA 88, 2931-2935 (1991).

35. A. A. Alabi, M. I. Bahamonde, H. J. Jung, J. I. Kim, K. J. Swartz, Portability of paddle motif function and pharmacology in voltage sensors. Nature 450, 370-376 (2007).

36. F. Bosmans, M. F. Martin-Eauclaire, K. J. Swartz, Deconstructing voltage sensor function and pharmacology in sodium channels. Nature 456, 202-208 (2008).

37. S. Sokolov, T. Scheuer, W. A. Catterall, Gating pore current in an inherited ion channelopathy. Nature 446, 76-78 (2007).

38. F. Tombola, M. M. Pathak, E. Y. Isacoff, Voltage-sensing arginines in a potassium channel permeate and occlude cation-selective pores. Neuron 45, 379-388 (2005).

39. S. Sokolov, T. Scheuer, W. A. Catterall, Ion permeation through a voltage-sensitive gating pore in brain sodium channels having voltage sensor mutations. Neuron 47, 183-189 (2005).

40. S. C. Cannon, Voltage-sensor mutations in channelopathies of skeletal muscle. J. Physiol. 588, 1887-1895 (2010).

41. A. Banerjee, R. MacKinnon, Inferred motions of the S3a helix during voltage-dependent K+ channel gating. J. Mol. Biol. 381, 569-580 (2008).

42. H. P. Larsson, O. S. Baker, D. S. Dhillon, E. Y. Isacoff, Transmembrane movement of the Shaker K+ channel S4. Neuron 16, 387-397 (1996).

43. F. Tombola, M. M. Pathak, P. Gorostiza, E. Y. Isacoff, The twisted ion-permeation pathway of a resting voltage-sensing domain. Nature 445, 546-549 (2007).

44. L. Delemotte, W. Treptow, M. L. Klein, M. Tarek, Effect of sensor domain mutations on the properties of voltage-gated ion channels: Molecular dynamics studies of the potassium channel Kv1.2. Biophys. J. 99, L72-L74 (2010).

45. F. Khalili-Araghi, E. Tajkhorshid, B. Roux, K. Schulten, Molecular dynamics investigation of the omega-current in the Kv1.2 voltage sensor domains. Biophys. J. 102, 258-267 (2012).

46. D. M. Starace, F. Bezanilla, A proton pore in a potassium channel voltage sensor reveals a focused electric field. Nature 427, 548-553 (2004).

47. M. Lainé et al, Atomic proximity between S4 segment and pore domain in Shaker potassium channels. Neuron 39, 467-481 (2003).

48. K. H. Hong, C. Miller, The lipid-protein interface of a Shaker K+ channel. J. Gen. Physiol. 115, 51-58 (2000).

49. F. V. Campos, B. Chanda, B. Roux, F. Bezanilla, Two atomic constraints unambiguously position the S4 segment relative to S1 and S2 segments in the closed state of Shaker K channel. Proc. Natl. Acad. Sci. USA 104, 7904-7909 (2007).

Example 8: Supporting Material, Mechanism of Voltage Gating in $K^+$ Channels

Methods

Simulation Systems.

The pore and voltage-sensing domains (residues 148-421) of the fully functional (1) $K_v1.2/K_v2.1$ chimera [PDB entry 2R9R, (2)] were embedded in a palmitoyl oleolyl phosphatidylcholine (POPC) bilayer solvated in ~0.5 M KCl; the functionally nonessential T1 domain (3, 4, 5) and regulatory β-subunit, both of which were present in the chimera crystal structure, were omitted. Residue protonation states corresponded to pH 7. System sizes ranged from ~107,000 atoms (110×110×87 Å$^3$) to ~150,000 atoms (125×125×87 Å$^3$), scaling with bilayer size. All simulations were initiated with $K^+$ ions and water molecules at alternating positions in the selectivity filter (SF). Additional simulations that included the T1 domain were performed under identical conditions (membrane composition, ion concentration, residue protonation states, and initial SF occupancy). The system size was 230,000 atoms (125×125×145 Å$^3$).

Simulations.

Five all-atom molecular dynamics simulations (FIG. 21; simulations 4-8: 150, 215, 211, 216, and 256 μs) of the activated-to-resting transition were performed at hyperpolarizing voltages ($-750 \leq V \leq -375$ mV), as well as three control simulations (1-3: 80, 33, and 14 μs) at depolarizing voltages (1, 2: +750 mV; 3: +375 mV). Three additional depolarizing simulations (9-11: +750 mV, 20-33 μs), without the T1 domain, of the resting-to-activated transition were performed. These three simulations were initiated from fully dewetted (pore fully closed) or partially dewetted (pore partially open) conformations; in each simulation the voltage-sensing domains (VSDs) were in the activated ("up") conformation. Two depolarizing simulations (12: +375 mV, 80 μs; 13: +500 mV, 68 μs), with the T1 domain included, of the resting-to-activated transition were also performed. Both simulations were initiated from the resting state, with the fully dewetted (pore fully closed) conformation, and with all but one (12) or all (13) of the VSDs in the completely deactivated ("down") conformation. The aggregate simulation time was 1,500 μs (FIG. 21).

All simulations used the CHARMM27 force field for protein, ions, and water (6, 7); the C36 force field was used for lipids (8). Torsional backbone corrections were added to SF residues Gly376 and Gly378 to prevent SF degradation on a timescale of microseconds (9; the local φ-maximum at 100° was converted to a local minimum through an m=6 order torsional correction: $U=\Sigma_m(-1)^{m-1}\cdot[(1+\cos m(\varphi-\varphi'))/m!]$. The side-chain charges of aspartate, glutamate and arginine residues ("DER" correction; FIG. 22) were adjusted to weaken the guanidinium acetate association constant; this correction weakened the 4.6 M$^{-1}$ association constant obtained with standard CHARMM27 parameters to 0.9 M$^{-1}$, more in line with the experimental value of 0.3-0.5 M$^{-1}$(10, 11). The "DER2" correction (FIG. 22) further weakened the calculated association constant to 0.4 M$^{-1}$, to even more closely reproduce the experimental value.

Simulations were performed on a special-purpose machine, Anton (12), designed for molecular dynamics simulations (NPT ensemble; 310 K, 1 bar, Berendsen coupling scheme with one temperature group [13]). All bond lengths to hydrogen atoms were constrained using M-SHAKE (14). Van der Waals and short-range electrostatic interactions were cut off at 10 Å. Long-range electrostatic interactions were calculated using the Gaussian Split Ewald method (15) with a 64×64×64 FFT mesh. The simulation time step was 2 fs (2.5 fs in simulations 8, 12, and 13); long-range electrostatics were evaluated every third step. The protein was initially relaxed in the membrane, for >2 μs, without application of a transmembrane potential. Thereafter, a potential was imposed, implemented as a constant electric field of ±0.01-0.2 kcal·mol$^{-1}$·Å$^{-1}$·e$^{-1}$, as described (9). The field was increased linearly to full strength over 1 μs and held constant thereafter; for simulations at hyperpolarizing voltage, after the transition to the resting state was either fully or nearly complete (defined as a gating charge of ~10 e), the magnitude of the applied voltage was typically lowered by 50%; in simulation 8, however, the voltage was increased by 33%, and the simulations were then continued for at least another 10 μs, to ensure that the resting state remained stable. Trajectories were saved at 300-ps intervals and were analyzed using HiMach (16), which integrates VMD and its plugins (17).

Simulations 2-7, 9, and 11 (FIG. 21) used the DER charges (FIG. 22), simulations 1 and 10 used standard CHARMM27 charges, and simulations 8, 12, and 13 used DER2 charges. Simulation 7 was initiated with standard charges, but was then restarted with DER charges. At first, this simulation, at hyperpolarizing voltage, was extended for 55 μs beyond the time of cavity dewetting (from 45 to 100 μs) without significant gating-charge displacement relative to depolarizing control simulations 1 and 2. The switch to DER charges at 45 μs, however, permitted VSD relaxation to commence. At depolarizing voltages, no differences were discernible between simulations performed with standard versus DER charges. To accommodate more complete VSD relaxation, additional lipid molecules were added to simulations 6 and 7 (107,000 atoms increased to 150,000 atoms), at 24 and 62 μs. Simulations 9-11 were started from snapshots of (hyperpolarizing) simulation 7 (with 107,000 atoms), at 45 μs (simulation 9) and 48 μs (simulations 10 and 11), in which all VSD gating-charge residues were still "up" (outward of Phe233) and in which the pore cavity was either partially (simulation 9) or fully dewetted (simulations 10 and 11). Application of a reversed, depolarizing voltage led to complete cavity rewetting within 10 μs and concurrent steady-state outward $K^+$ conduction (19.1±0.1, 20.7±2.7, and 20.7±3.7 pA in simulations 9, 10, and 11, respectively; cf. simulation 1, 18.8±0.8 pA).

Simulations that included the T1 domain (FIG. 21; simulations 8, 12, and 13) were performed at reduced voltage magnitudes. Simulation 8 (−375 mV) was initiated with DER charges, but was then restarted with DER2 charges, at 78 μs, because no noticeable gating charge displacement had occurred with DER charges at this relatively weak applied voltage; cavity dewetting was observed with DER charges, at 33 μs (FIG. 21). The switch to DER2 charges led to complete VSD relaxation, over ~200 μs. The last ~50 μs was performed with a slightly increased voltage magnitude (33%), to drive the activating-to-resting state transition to completion. Simulations 12 (+375 mV) and 13 (+500 mV) used DER2 charges throughout.

Experimental time constants were corrected for temperature differences between simulation (T=310 K) and experiment (T'=293 K) using the relationship: $\tau_{T'}=\tau_T Q_{10}^{(T'-T)/10}$. For the tail current, $\tau_{293\ K}$=0.308 ms and $Q_{10}$~4.8 (18); for the slow off-gating component, $\tau_{293\ K}$=3-4 ms and $Q_{10}$~4 (19). Throughout, error bars and "±" represent standard error of the mean.

Analysis.

Trajectories, accessed from a parallel disk cache system called Zazen (60), were analyzed using HiMach (61), which integrates VMD and its plugins (62).

Helix Rotation Calculations.

The local S4 helical axis was obtained from the principal inertial axes of gating-charge residues R2, R3, or R4 together with the two preceding and two following residues (N, $C_\alpha$, C, and O atoms only). That principal axis nearest the mean C=O direction of these five residues was chosen as the local helical axis (x-axis; "roll"), rotation around which is shown in FIG. 17b. The local y-axis ("pitch") was defined as the mean of the vectors (perpendicular to the roll axis) through the $C_\beta$ atoms of the preceding and following residues; the pitch axis thus coincides roughly with the R2, R3, or R4 side chain. The local z-axis ("yaw") was defined as z=x×y. Eulerian angles (rotations in order: yaw; pitch; roll) for this local reference frame were computed relative to the simulation start (all angles zero). Yaw and pitch, which together define the (changing) direction of the S4 helix axis, varied little)(±20° throughout. Roll was mostly negative, i.e., viewed from the extracellular side, S4 rotated in the counter-clockwise direction relative to the rest of the VSD as helix S4 moved inward (FIG. 17b).

Transmembrane-Potential Calculations.

For both activated and resting states, the transmembrane-voltage profile through the VSD was computed from simulations of a single VSD (residues 148-321) embedded in a single bilayer, imposing a depolarizing potential difference (V) implemented as a constant electric field (0 or +0.2 kcal·mol$^{-1}$·Å$^{-1}$·e$^{-1}$ [0 or +750 mV]), as above.

The fractional potential drop, relative to V, was probed along the membrane normal (z) at the gating-charge residues R2-R6 (R1(Q) and R0 were also included for the resting state) using free-energy calculations, performed with Desmond (20). First, eight charging (2={0.00, 0.15, 0.31, 0.45, 0.63, 0.77, 0.89, 1.00}) and then nine coupling (2={0.000, 0.107, 0.175, 0.225, 0.282, 0.366, 0.501, 0.710, 1.000}) windows were used. Each window was simulated for 2.1 ns, and the Bennett acceptance method (21) was used to obtain the Gibbs free energy. The fractional potential drop, f(z), was obtained as (22): f(z)=−ΔΔG(z)/qV+(z+$L_z$/2)/$L_z$. ΔΔG (V; z)=ΔG(V>0; z)−ΔG(V=0; z) is the potential (free) energy difference, between introducing a gating charge (q) in the presence or absence of the electric field. The non-uniform charge distribution across the VSD modifies (non-linearly) the linear potential drop, (z+$L_z$/2)/$L_z$, contributed by the constant electric field (truncated outside±$L_z$/2, noting that $L_z$=30 Å fully encompasses the region over which the transmembrane field acts).

The values calculated above for the fractional potential drop were fit to f(z)=1/[exp(−c(z−z')+1], with resulting parameters [c, z'] of [0.52 Å$^{-1}$, 4.4 Å] and [0.44 Å$^{-1}$, 5.0 Å] for the activated (A) and resting (R) states. From these f(z) curves, 95% of the potential drop was found to be distributed over an ~15-Å-wide region in both states (FIG. 17c, inset). The activated-state parameters were used in computation of the gating-charge displacement; see main text and FIG. 17c, inset. The (single VSD) gating charge can also be estimated as Q=$\Sigma_i q_i$ [f($z_{i,R}$))−f($z_{i,A}$)]=2.5 e, summing over gating-charge residues R2-R6 only; use of this subset of S4 residues implies that this estimate is lower, by ~1 e, than the value of ~13.5 e expected for the either the entire S4 or the full VSD (FIG. 17c).

"Omega" Pore Simulations.

For simulation of omega currents (FIG. 23), two resting-state VSD configurations obtained through simulations—one with R2 at Phe233 (R2-R4 "down"; simulation 4 at t=72 μs) and the other with R0 at Phe233 (R0, R2-R4 "down"; simulation 3 at t=200 μs)—were converted to omega pores by introduction of R2Ser or R0Asn mutations, respectively. Glu226 was also mutated to aspartate, because the longer glutamate side chain could block or interfere with the omega current [it is known that the corresponding Shaker mutation, Glu283Asp, enhances omega currents (23)]; back-mutation of Asp226 to glutamate had no systematic effect on omega currents. The mutant VSDs were embedded in a hydrated POPC bilayer (system size 40,000 atoms), as described above (both CHARMM27 and C36 parameters were used for the lipids, but no difference resulted), and were simulated at hyperpolarizing voltages for ~10 to ~130 μs. To terminate the omega currents and reactivate the sensor, two (inwardly conducting) snapshots (both at 10 µs) from the simulations were taken and then imposed reverse (depolarizing) voltages (see FIG. 23). The aggregate simulation time of the omega pore constructs was ~300 µs.

SUPPORTING REFERENCES

1. X. Tao, R. MacKinnon, Functional analysis of Kv1.2 and paddle chimera Kv channels in planar lipid bilayers. J. Mol. Biol. 382, 24-33 (2008).
2. S. B. Long, X. Tao, E. B. Campbell, R. MacKinnon, Atomic structure of a voltage-dependent K+ channel in a lipid membrane-like environment. Nature 450, 376-382 (2007).
3. A. M. VanDongen, G. C. Frech, J. A. Drewe, R. H. Joho, A. M. Brown, Alteration and restoration of K+ channel function by deletions at the N- and C-termini. Neuron 5, 433-443 (1990).
4. H. T. Kurata, G. S. Soon, D. Fedida, Altered state dependence of C-Type inactivation in the long and short forms of human Kv1.5. J. Gen. Physiol. 118, 315-332 (2001).
5. W. R. Kobertz, C. Miller, K+ channels lacking the 'tetramerization' domain: implications for pore structure. Nature Struct. Biol. 6, 1122-1125 (1999).
6. A. D. MacKerell, Jr. et al., All-atom empirical potential for molecular modeling and dynamics studies of proteins. J. Phys. Chem. B 102, 3586-3616 (1998).
7. A. D. MacKerell, Jr., M. Feig, C. L. Brooks, III, Extending the treatment of backbone energetics in protein force fields: Limitations of gas-phase quantum mechanics in reproducing protein conformational distributions in molecular dynamics simulations. J. Comput. Chem. 25, 1400-1415 (2004).
8. J. B. Klauda et al., Update of the CHARMM all-atom additive force fields for lipids: Validation on six lipid types. J. Phys. Chem. B 114, 7830-7843 (2010).
9. M. Ø. Jensen et al., Principles of conduction and hydrophobic gating in K+ channels. Proc. Natl. Acad. Sci. USA 107, 5833-5838 (2010).
10. C. Tanford, The association of acetate with ammonium and guanidinium ions. J. Am. Chem. Soc. 76, 945-946 (1954).
11. B. Springs, P. Haake, Equilibrium constants for association of guanidinium and ammonium ions with oxyanions: The effect of changing basicity of the oxyanion. Bioorg. Chem. 6, 181-190 (1977).
12. D. E. Shaw et al., Millisecond-scale molecular dynamics simulations on Anton. Proc. Conf. High Performance Computing, Networking, Storage and Analysis (SC09) (ACM Press, New York, 2009).
13. H. J. C. Berendsen, J. P. M. Postma, W. F. van Gunsteren, A. Di Nola, J. R. Haak, Molecular dynamics with coupling to an external bath. J. Chem. Phys. 81, 3684-3690 (1984).
14. V. Krautler, W. F. van Gunsteren, P. H. Hünenberger, A fast SHAKE algorithm to solve distance constraint equations for small molecules in molecular dynamics simulations. J. Comput. Chem. 22, 501-508 (2001).
15. Y. Shan, J. L. Klepeis, M. P. Eastwood, R. O. Dror, D. E. Shaw, Gaussian split Ewald: A fast Ewald mesh method for molecular simulation. J. Chem. Phys. 122, 054101:1-13 (2005).
16. T. Tu et al., A scalable parallel framework for analyzing terascale molecular dynamics simulation trajectories. Proceedings of the ACM/IEEE Conference on Supercomputing (SC08) (ACM Press, New York, 2008).
17. W. Humphrey, A. Dalke, K. Schulten, V M D: Visual Molecular Dynamics. J. Mol. Graphics 14, 33-38 (1996).
18. B. M. Rodriguez, F. Bezanilla, Transitions near the open state in Shaker K+-channel: Probing with temperature. Neuropharmacology 35, 775-785 (1996).
19. B. M. Rodriguez, D. Sigg, F. Bezanilla, Voltage gating of Shaker K+ channels. The effect of temperature on ionic and gating currents. J. Gen. Physiol. 112, 223-242 (1998).
20. K. J. Bowers et al., Scalable algorithms for molecular dynamics simulations on commodity clusters. Proc. ACM/IEEE Conf. on Supercomputing (SC06) (ACM Press, New York, 2006).
21. C. H. Bennett, Efficient estimation of free energy differences from Monte Carlo data. J. Comput. Phys. 22, 245-268 (1976).
22. B. Roux, The membrane potential and its representation by a constant electric field in computer simulations. Biophys. J. 95, 4205-4216 (2008).
23. F. Tombola, M. M. Pathak, E. Y. Isacoff, Voltage-sensing arginines in a potassium channel permeate and occlude cation-selective pores. Neuron 45, 379-388 (2005).

Example 9: Expression of Shaker Channel Constructs in *Xenopus* Oocytes

The coding cDNAs of Shaker "wild-type" (hereinafter WT) base construct (Shaker H4, with intact inactivation), Shaker R362S with alpha pore open (hereinafter R1 S) and Shaker with the alpha pore closed by mutation W434F (herein after R1 S/W434F) were cloned into a high expression vector pBSTA. The C-terminus of all constructs was tagged with eGFP. Transcripted cRNA was produced using the mMessage mMachine kit (Ambion Inc.).

Two to four days past injection of cRNA into stage V-VI *Xenopus* oocytes (NASCO), omega currents ($I\omega$) and currents through the alpha pore ($I\alpha$) were recorded with the two electrode voltage-clamp technique making use of a TURBO TEC-05X amplifier (npi electronic GmbH). Currents were filtered at 10 kHz and sampled at 20 kHz. The bath solution contained (in mM): NaCl 96, KCl 2, $CaCl_2$ 1, $MgCl_2$ 1 and HEPES 5 (pH 7.5). Voltage-recording and current-injecting microelectrodes were filled with 3 M KCl and pulled to have resistances between 0.2 and 1 MΩ (see Stork et al., 2007). The pClamp software package v.10.1 (Molecular Devices, Inc.) was used for data acquisition and analysis.

Example 10: Recording of Alpha Currents ($I\alpha$)

Pulses (50 ms) were applied from −60 to +60 mV in 10 mV steps at 1 Hz from a holding potential of either −80 mV (WT, R1S/W434F) or −50 mV (R1S) (see insets in FIGS. 33B and 33D respectively) to measure alpha currents ($I\alpha$). Passive leak currents were subtracted online using a P/4 procedure: pClamp software generates a series of scaled-down replica sweeps of the main stimulus waveform. These subsweeps are of the same duration as the main sweep, but of lesser amplitude; amplitudes in the subsweeps are inversely proportional to the number of subsweeps selected (usually 4, hence P/4). The cell's response to the subsweeps is used to calculate the degree of passive cellular current leak. This is then subtracted from acquired data on the associated input signal.

Example 11: Recording of Omega Currents ($I\omega$)

Pulses (20 ms) from +60 to −300 mV were applied in 20 mV steps at 1 Hz from a holding potential of either −80 mV (WT, R1S/W434F) or −50 mV (R1S) (see FIG. 34B) to measure omega currents (Iω) without leak subtraction.

Example 12: Drug Application and Analysis

Lanthanum(III) chloride heptahydrate (LaCl$_3$.7H$_2$O, Sigma-Aldrich) was freshly dissolved in the bath solution. La$^{3+}$ was applied to *Xenopus* oocytes by means of a fast perfusion technique (ScreeningTool, npi electronic GmbH as described by Baburin et al., 2006). Origin software v.7.0 (OriginLab Corp.) was employed for data analysis. Inhibition of omega currents (in %) was defined as (1−Iω,drug/Iω,control)*100, where Iω, drug is the current response in the presence of a given concentration of drug and Iω,control is the control omega current. Data are given as mean±SE (n=number of experiments).

Example 13: Demonstration of the I/V Relationship for WT and R1S Shaker Channels with Intact Inactivation Expressed in *Xenopus* Oocytes Electrophysiological characterization of WT and R1S Shaker channels expressed in *Xenopus* oocytes injected with the corresponding cRNAs are shown in FIG. 33. I/V relationships of WT (A), R1S (C) are shown. Currents were normalized to the maximal current at +60 mV (mean data from 7 oocytes (A) and 4 oocytes (C)). Normalized current amplitudes at given voltages are shown as mean values±S.E. (hidden by symbols). Typical potassium outward currents through WT (B) and mutant R1S (D) channels are illustrated on the right panel. The insets display the corresponding voltage protocols and holding potentials.

Example 14: Demonstration that Inward Gating Pore Leak Currents at Large Negative Voltages are not Present in WT Shaker with Intact Inactivation Electrophysiological characterization of WT Shaker channels expressed in *Xenopus* oocytes injected with the corresponding cRNA are shown in FIG. 34. The I/V curve in (A) illustrates that Iω are not present in WT Shaker. Test pulses were applied from +60 mV to −300 mV (illustrated in B). Currents were normalized to the maximal current at +60 mV (data from 7 oocytes). Normalized current amplitudes at given voltages are shown as mean values±S.E. (hidden by symbols). Typical potassium outward currents through WT (C) are illustrated on the lower panel. Same experiment at higher resolution is shown in (D) illustrating an unspecific inward conductance developing at pulses negative to −260 mV (see also mean values in A at −280 and −300 mV). This current was also seen in non injected oocytes and may represent instability of the membrane at very negative voltages.

Example 15: Demonstration that Inward Gating Pore Leak Currents at Large Negative Voltages are Present in R1S Shaker and that the Gating Pore Leak Current is Blocked by La$^{3+}$ Ions I/V curves in FIG. 35 (A) illustrate that Iω is present in R1S and that this current is blocked by La$^{3+}$. Test pulses were applied from +60 mV to −300 mV (same voltage steps as in FIG. 34B applied from a holding potential of −50 mV). Currents were normalized to the maximal current at +60 mV. Control R1S I/V curve (squares) and I/V curves in the presence of 30 (circles), 100 (triangles) and 300 .mu.M La$^{3+}$ (diamonds) are shown (data from 4 oocytes). Normalized current amplitudes at given voltages are shown as mean values±S.E. Typical potassium outward currents through R1S and omega currents in control (B) and in the presence of 30 μM (C) and 300 μM La$^{3+}$ (D) are illustrated.

Example 16: Demonstration that Inward Gating Pore Leak Currents at Large Negative Voltages are Still Present in R1S Shaker when the Alpha Pore is Closed by the W434F Mutation I/V curve in FIG. 36(A) illustrates that Iω is present in R1S/W434F. This construct conducts no alpha current (compare outward currents during depolarising pulses positive to 0 mV with FIGS. 33-35). Test pulses were applied from +60 mV to −300 mV (same voltage protocol as in FIG. 34 B). Current amplitudes at given voltages are shown as mean values±S.E (data from 6 oocytes). (B) and (C) illustrate the absence of outward currents and at a higher resolution (C) the presence of omega currents in construct R1S/W434F. (D) Iω was induced by voltage steps from a holding potential of −80 mV to −200 mV (see inset) Inhibition of Iω induced by 100 μM La$^{3+}$ occurred in a "use-dependent" manner. The lower trace (control, in the absence of La$^{3+}$) is superimposed by twenty currents during 20 ms pulses applied at a frequency of 1 Hz. During the first pulse 100 μM La$^{3+}$ blocked 31.8±3.6%. At steady state omega currents were typically blocked by 51.5±5.9% (data from 5 oocytes).

Example 17: R1S and R1S/W434F Shaker, but not WT Shaker, Exhibit a Gating Pore Leak Current that can be Blocked by a Pharmacological Agent The data presented in FIG. 33, FIG. 34, FIG. 35, and FIG. 36 together illustrate that WT and R1S display the expected IN curves in regards to outward currents activated at voltages positive to −20 mV. Omega currents for R1S and R1S/W434F Shaker only started to activate at hyperpolarizing pulses negative to −80 mV. These currents were only recorded in R1S and R1S/W434F but not in WT Shaker. Omega currents were blocked in a concentration-dependent manner by La$^{3+}$. Omega currents are blocked by La$^{3+}$ in a state-dependent manner (FIG. 36).

REFERENCES FOR EXAMPLES 9-17

Baburin I, Beyl S and Hering S (2006) Automated fast perfusion of *Xenopus* oocytes for drug screening. *Pflügers Arch* 453(1): 117-23.

Stork D, Timin E N, Berjukow S, Huber C, Hohaus A, Auer M, et al. (2007) State dependent dissociation of hERG channel inhibitors. *Br J Pharmacol* 151(8): 1368-76.

Tombola F, Pathak M M, Gorostiza P, Isacoff E Y (2007) The twisted ion-permeation pathway of a resting voltage-sensing domain. *Nature* 445(7127): 546-9.

Example 18: Expression of Kv2.1 Channel Constructs in *Xenopus* Oocytes

The coding cDNAs of KV2.1 "wild-type" (hereinafter WT) base construct (hKv2.1-m7-c3 is human Kv2.1, residues 1-858, mutated to confer AgTx2 sensitivity and to remove extracellular cysteine residues) was synthesized (Entelchon GmbH) and cloned into the high expression vector pBSTA.

Mutations Kv2.1 R294N (hereinafter R0N), Kv2.1 R300S (hereinafter R2S), Kv2.1 R294C/R300S (hereinafter R0C/R2S), Kv2.1 R293S/R294S (hereinafter R-1S/R0S), Kv2.1

R293S/R294C (hereinafter R-1S/ROC), Kv2.1 R293S/R294S/R300S (hereinafter R-1S/R0S/R2S), Kv2.1 R293S/R294C/R300S (hereinafter R-1S/R0C/R2S) were introduced using the QuikChange® Lightning Site-Directed Mutagenesis Kit (Stratagene) with mutagenic primers according to the manufacturer's instructions. All constructs were checked by restriction site mapping and sequencing.

Transcripted cRNA was produced using the mMessage mMachine kit (Ambion Inc.). Two to four days past injection of cRNA into stage V-VI *Xenopus* oocytes (NASCO) potassium currents through the alpha pore (Iα) were recorded with the two electrode voltage-clamp technique making use of a TURBO TEC-05X amplifier (npi electronic GmbH). Currents were filtered at 10 kHz and sampled at 20 kHz. The bath solution contained (in mM): NaCl 96, KCl 2, CaCl2 1, MgCl2 1 and HEPES 5 (pH 7.5). Voltage-recording and current-injecting microelectrodes were filled with 3 M KCl and pulled to have resistances between 0.2 and 1 MΩ (see Stork et al., 2007). The pClamp software package v.10.1 (Molecular Devices, Inc.) was used for data acquisition and analysis.

Example 19: Voltage Protocol, Compounds, and Drug Application and Analysis

For recording of alpha currents (Iα), 100 ms pulses were applied from −60 to +60 mV in 10 mV steps at 1 Hz from a holding potential of −80 mV to the Kv2.1 channel constructs to measure alpha currents (Iα). Passive leak currents were subtracted online using a P/4 procedure: pClamp software generates a series of scaled-down replica sweeps of the main stimulus waveform. These subsweeps are of the same duration as the main sweep, but of lesser amplitude; amplitudes in the subsweeps are inversely proportional to the number of subsweeps selected (usually 4, hence P/4). The cell's response to the subsweeps is used to calculate the degree of passive cellular current leak. This is then subtracted from acquired data on the associated input signal. There was no evidence for omega currents in this voltage range that could potentially interfere with the leak subtraction.

AgTx2 (Sigma Aldrich) was reconstituted according to manufacturer's instructions with 10 mM Tris, pH 7.5, containing 100 mM sodium chloride, 0.1% bovine serum albumin, and 1 mM EDTA.

AgTx2 was applied to *Xenopus* oocytes by means of a fast perfusion technique (ScreeningTool as described by Baburin et al., 2006). Origin software v.7.0 (OriginLab Corp.) was employed for data analysis. Inhibition of alpha currents (in percentage) was defined as (1−Iα,drug/Iα,control)*100, where Iα,drug is the current response in the presence of a given concentration of AgTx2 and Iα,control is the control potassium current. Data are given as mean±SE (n=number of experiments).

Example 20: Demonstration of the I/V Relationships, Outward Potassium Currents, and Mean Outward Currents for WT and Mutant Kv2.1 Channels The I/V relationships of various Kv2.1 channels constructs expressed in *Xenopus* oocytes injected with the corresponding cRNAs are shown in FIG. 37. WT (A), R0N (B), R2S(C), R0C/R2S (D), R-1S/R0S (E), R-1S/R0C (F), R-1S/R0S/R2S (G) and R-1 S/R0C/R2S(H) Kv2.1 channel constructs expressed in *Xenopus* oocytes are illustrated. Currents were normalized to the maximal current at +60 mV (data from 9 (A), 7 (B), 6 (C), 4 (D), 8 (E), 4 (F), 7 (G) and 4 oocytes (H)). Normalized current amplitudes at given voltages are shown as mean values±S.E. (hidden by symbols). Typical potassium outward currents though the designated channel constructs are shown in FIG. 38: WT (A), R0N (B), R2S(C), R0C/R2S (D), R-1S/R0S (E), R-1S/R0C (F), R-1S/R0S/R2S (G) and R-1S/R0C/R2S(H). Mean maximal outward currents at +60 mV through the designated Kv2.1 constructs (in μA; two batches, n≥3) are shown in FIG. 39.

Example 21: Demonstration that the Central Pore (Alpha) Current of Kv2.1 WT and Mutant Channels is Blocked by AgTx2

Figure 40:
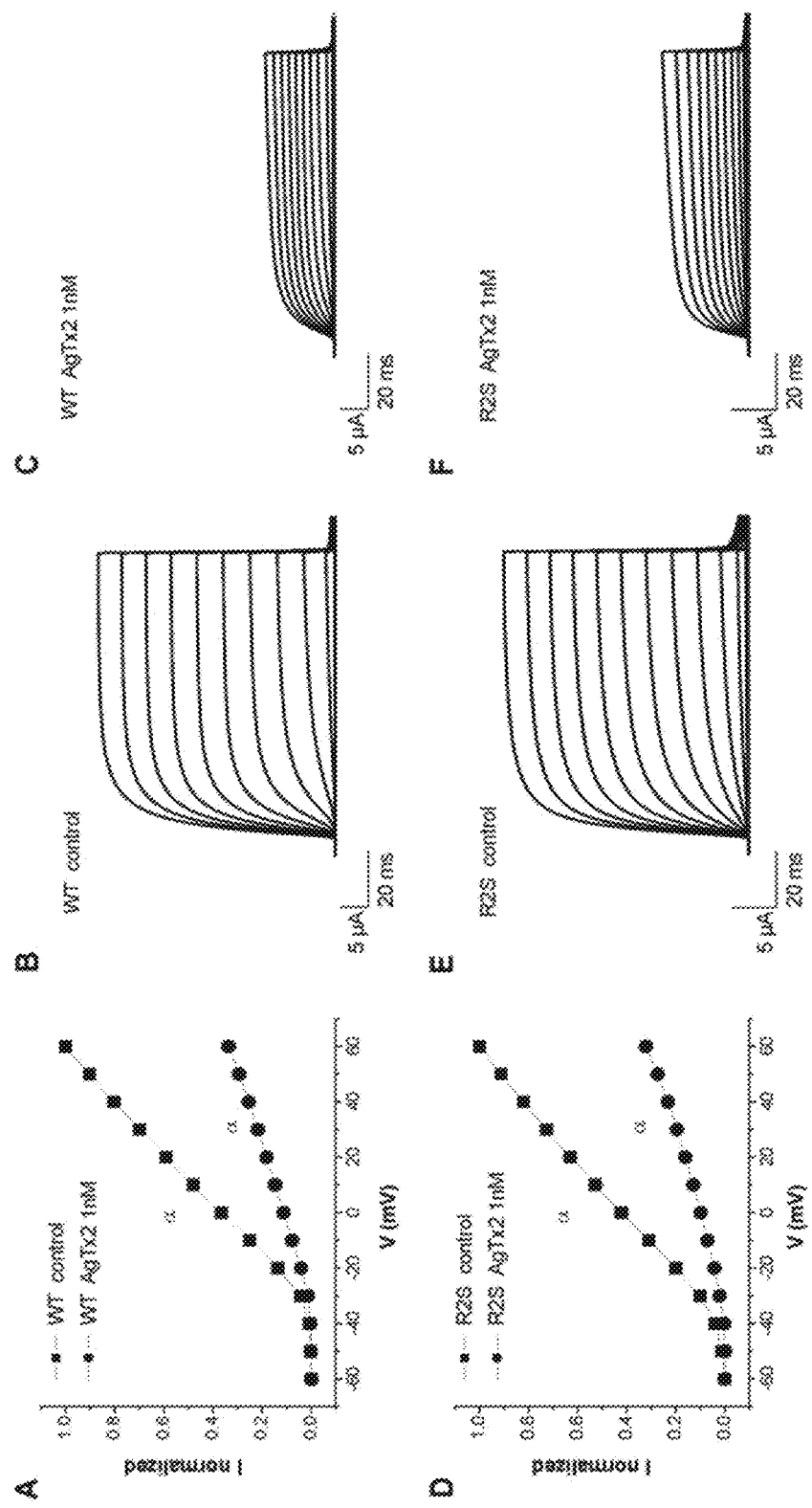

UV relationships for Kv2.1 channels in the absence and presence of AgTx2 are shown in FIG. 40. WT (A) and R2S (D) channels are shown in the absence (control, squares) and presence of 1 nM AgTx2 (circles). Peak currents were normalized to the maximal current at +60 mV. Normalized peak current amplitudes at given voltages are shown as mean values±S.E. (hidden by symbols). The mean inhibition of the maximal outward current at +60 mV amounted 66.5±2.9% (n=4, WT) and 67.8±2.8% (n=5, R2S). Typical potassium outward currents through WT and R2S Kv2.1 channels in control (B, E) and in the presence of 1 nM AgTx2 (C, F) are illustrated respectively.

The data in FIG. 37, FIG. 38, FIG. 39, and FIG. 40 illustrate that WT, R0N, R2S, R0C/R2S, R-1S/R0S, R-1S/R0C, R-1S/R0S/R2S and R-1S/R0C/R2S display the expected I/V curves in regards to outward (alpha) currents activated at voltages positive to −60 mV. Outward current activated at voltages positive to −40 mV (see Gross et al., 1994). Furthermore, by cloning the constructs into pBSTA we achieved high expression levels. This is evident from the mean maximal currents at +60 mV ranging from 8.5±0.9 μA in R-1S/R0S/R2S to 42.0±5.2 μA in R0N (WT: 41.6±5.4 μA). WT and R2S alpha currents were blocked by 1 nM AgTx2 by 66.5±2.9% and 67.8±2.8% respectively.

REFERENCES FOR EXAMPLES 18-21

Baburin I, Beyl S and Hering S (2006) Automated fast perfusion of *Xenopus* oocytes for drug screening. *Pflügers Arch* 453(1): 117-23.
Stork D, Timin E N, Berjukow S, Huber C, Hohaus A, Auer M, et al. (2007) State dependent dissociation of hERG channel inhibitors. *Br J Pharmacol* 151(8): 1368-76.
Gross A., Abramson T. and MacKinnon R. (1994) Transfer of the scorpion toxin receptor to an insensitive potassium channel. *Neuron*, 13, 961-966.

Example 22: Further Expression of Kv2.1 Channel Constructs in *Xenopus* Oocytes

The coding cDNAs of KV2.1 "wild-type" (hereinafter WT) base construct (hKv2.1-m7-c3 is human Kv2.1, residues 1-858, mutated to confer AgTx2 sensitivity and to remove extracellular cysteine residues) was synthesized (Entelchon GmbH) and cloned into the high expression vector pBSTA.

Mutations Kv2.1 R294N (hereinafter R0N), Kv2.1 R300S (hereinafter R2S), Kv2.1 R294C/R300S (hereinafter R0C/R2S), Kv2.1 R293S/R294S (hereinafter R-1S/R0S), Kv2.1 R293S/R294C (hereinafter R-1S/ROC), Kv2.1 R293S/R294S/R300S (hereinafter R-1S/R0S/R2S), Kv2.1 R293S/R294C/R300S (hereinafter R-1S/R0C/R2S) were introduced using the QuikChange® Lightning Site-Directed Mutagenesis Kit (Stratagene) with mutagenic primers according to the manufacturer's instructions. All constructs were checked by restriction site mapping and sequencing.

Transcripted cRNA was produced using the mMessage mMachine kit (Ambion Inc.). Two to four days past injection of cRNA into stage V-VI *Xenopus* oocytes (NASCO) potassium currents through the alpha pore (Iα) were recorded with the two electrode voltage-clamp technique making use of a TURBO TEC-05X amplifier (npi electronic GmbH). Currents were filtered at 10 kHz and sampled at 20 kHz. The bath solution contained (in mM): NaCl 96, KCl 2, CaCl2 1, MgCl2 1 and HEPES 5 (pH 7.5). Voltage-recording and current-injecting microelectrodes were filled with 3 M KCl and pulled to have resistances between 0.2 and 1 MΩ (see Stork et al., 2007). The pClamp software package v.10.1 (Molecular Devices, Inc.) was used for data acquisition and analysis.

Example 23: Voltage Protocols, Compounds, and Drug Application and Analysis

Recording of alpha currents (Iα): Pulses of 100 ms were applied from −60 to +60 mV in 10 mV steps at 1 Hz from a holding potential of −80 mV to the Kv2.1 channel constructs to measure alpha currents (Iα). Passive leak currents were subtracted online using a P/4 procedure: pClamp software generates a series of scaled-down replica sweeps of the main stimulus waveform. These subsweeps are of the same duration as the main sweep, but of lesser amplitude; amplitudes in the subsweeps are inversely proportional to the number of subsweeps selected (usually 4, hence P/4). The cell's response to the subsweeps is used to calculate the degree of passive cellular current leak. This is then subtracted from acquired data on the associated input signal. Recording of omega currents (Iω): Pulses of 10 ms were applied from a holding potential of −80 to −300 mV in 20 mV steps at 0.3 Hz to the Kv2.1 channel constructs. Iω were recorded without leak subtraction.

AgTx2 (Sigma Aldrich) was reconstituted according to manufacturer's instructions with 10 mM Tris, pH 7.5, containing 100 mM sodium chloride, 0.1% bovine serum albumin, and 1 mM EDTA. LaCl3 was from Sigma Aldrich; MTSEA, MTSES and MTSET were from Biotium.

La$^{3+}$, AgTx2, MTSEA, MTSES and MTSET and were applied to *Xenopus* oocytes by means of a fast perfusion technique (ScreeningTool as described by Baburin et al., 2006). Origin software v.7.0 (OriginLab Corp.) was employed for data analysis. Inhibition of inward currents was defined as 1−Iω,drug/Iω,control, where Iω,drug is the current response in the presence of a given concentration of lanthanum (La$^{3+}$) and Iω, control is the control current through the omega pore. The concentration-inhibition curve was fitted using the Hill equation: Iω,drug/Iω,control=A+A/(1+(C/IC50)$^{nH}$) where IC50 is the concentration at which Iω inhibition is half-maximal, C is the applied La$^{3+}$ concentration, A is the fraction of Iω current that blocked and nH is the Hill coefficient. Data are given as mean±SE (n=number of experiments).

Example 24: Demonstration that Inward Gating Pore Leak Currents (Iω) are Present in Certain Mutant, but not in WT or Other Mutant, K$_v$2.1 Channels at Large Negative Voltages Significant inward omega currents (Iω) were induced by triple mutations R-1S/R0C/R2S and R-1S/R0S/R2S, as illustrated in FIG. 41. Current-voltage relationships of WT, R0N, R2S, R0C/R2S, R-1S/R0C, R-1S/R0S, R-1S/R0C/R2S and R-1S/R0S/R2S Kv2.1 channel constructs normalized to maximal outward current at +60 mV. Inward currents were recorded during 10 ms hyperpolarising voltage steps from a holding potential of −80 mV to −300 mV (20 mV steps) in *Xenopus* oocytes injected with the corresponding cRNAs. Normalized current amplitudes at given voltages are shown as mean values±S.E. (n≥4, two batches of oocytes). Currents were not leak subtracted. Inward currents through the single and double mutants R0N, R2S, R0C/R2S, R-1S/R0C, and R-1S/R0S were not significantly different from WT.

Example 25: Demonstration that the Inward Gating Pore Leak Current (Iω) is not Blocked by AgTx2

Inward currents at negative potentials in oocytes expressing the Kv2.1 mutant R-1S/R0S/R2S were not inhibited by 10 nM AgTx2. This AgTx2 concentration is 10 times higher than the 1 nM AgTx2 which inhibits about 70% of the potassium outward current in WT and R2S Kv2.1 constructs. Illustrated in FIG. 42 are the inward current-voltage relationships of Kv2.1 construct R-1S/R0S/R2S in the absence (control, squares) and after 5 minutes in the presence of 10 nM AgTx2 (filled circles). Inward currents after 5 ms were normalized to the maximal outward current at +60 mV. Normalized inward current amplitudes at given voltages are shown as mean values±S.E. (n≥4, two batches of oocytes).

Example 26: Demonstration that the Inward Gating Pore Leak Current (Iω) is Blocked by La$^{3+}$ Ions Inward currents at negative potentials in oocytes expressing R-1S/R0S/R2S were blocked by La$^{3+}$ in a concentration-dependent manner, as illustrated in FIG. 43 and FIG. 44. FIG. 43 (A) illustrates the inward current-voltage relationships of construct R-1S/R0S/R2S in the absence (control; squares) and in the presence of the indicated concentrations of La$^{3+}$ (other symbols). Inward currents after 5 ms in control and La$^{3+}$ were normalized to the maximal outward current at +60 mV. Normalized inward current amplitudes at given voltages are shown as mean values±S.E. (n≥4, two batches of oocytes). FIGS. 43 (B, C) illustrate typical inward currents during hyperpolarising pulses through R-1S/R0S/R2S in the absence (B) and in the presence of 10 mM La$^{3+}$ (C). FIG. 44 (A) illustrates the concentration-dependent inhibition of the inward currents after 5 ms (normalized to control) through R-1S/R0S/R2S at −300 mV. The concentration-inhibition curve was fitted to the Hill equation. FIG. 44 (B) illustrates superimposed inward currents at −300 mV in the absence and in the presence of 30 μM, 100 μM, 300 μM, 1 mM, 3 mM and 10 mM La$^{3+}$. A half-maximal inhibition concentration (IC50) of 785±419 μM was estimated (nH=0.8±0.1; n>4, two batches of oocytes).

Example 27: Demonstration that the Inward Gating Pore Leak Current (Iω) is not Blocked by Certain Reagents Cysteine-reactive reagents MTSET, MTSES, or MTSEA were applied for 5 minutes to oocytes expressing the Kv2.1 R-1S/R0C/R2S mutant channel. To enable access of Cys294 during this period the channels were repeatedly activated by applying test pulses from −80 mV to 40 mV at a frequency of 0.3 Hz. FIG. 45 illustrates the inward current-voltage relationships of Kv2.1 mutant R-1S/R0C/R2S in the absence of (squares) and after 5 minutes application of 1 mM MTSEA (filled circles). FIG. 46 illustrates the inward current-voltage relationships of Kv2.1 mutant R-1S/R0C/R2S in the absence of (squares) and after 5 minutes application of 1 mM MTSES (filled circles). FIG. 47 illustrates the inward current-voltage relationships of Kv2.1 mutant R-1S/R0C/R2S in control (squares) and after 5 minutes application of 1 mM MTSET (filled circles). Inward currents after 5 ms in the absence of reagent or in the presence of the MTSEA, MTSES, or MTSET reagents were normalized to the inward current at −300 mV in the absence of reagent. Normalized inward current amplitudes at the indicated voltages are shown as mean values±S.E. (n≥4, two batches of oocytes).

Example 28: Suitability of Certain Channel Voltage Sensor Mutants for Screening

Only the Kv2.1 R-1 S/R0C/R2S and R-1S/R0S/R2S mutants conduct significantly larger inward currents during hyperpolarising test pulses than the WT channel. There was no evidence for Iω in the other Kv2.1 channel constructs. Our finding that Kv2.1 R0N, R2S, R0C/R2S mutants do not open an omega pore highlights structural differences in the voltage sensors between Shaker and Kv2.1. Shaker R1S mutant did exhibit an open omega pore. R-1 and R0 are not present in Shaker and Kv2.1 has a cysteine in the Shaker R0 position (see alignment illustrated in FIG. 48). Taken together, the Shaker R1S and the Kv2.1 R-1S/R0S/R2S triple mutant are suitable for drug screening on Iω. High expression levels in oocytes and corresponding large current amplitudes are required for reliable Iω measurements. Other channel types that are relevant for channelopathy mutations might also be considered for such studies.

REFERENCES FOR EXAMPLES 22-28

Baburin I, Beyl S and Hering S (2006) Automated fast perfusion of *Xenopus* oocytes for drug screening. *Pflügers Arch* 453(1): 117-23.
Stork D, Timin E N, Berjukow S, Huber C, Hohaus A, Auer M, et al. (2007) State dependent dissociation of hERG channel inhibitors. *Br J Pharmacol* 151(8): 1368-76.
Khodorov B. I. and Peganov E. (1969) Effect of calcium, magnesium, barium, nickel and Lanthanum ions on hyperpolarisation responses of single nodes of Ranvier. Biofizika, 14, 474-484.
Sokolov S. Scheuer T. and Catterall W. A. (2010) Ion permeation and block of the gating pore in the voltage sensor of Nav1.4 channels with hypokalemic periodic paralysis mutations. *J. Gen. Physiol.*, 136, 225-236.

Example 29: Guangxitoxin

GxTx-1E, a neurotoxin isolated from *Plesiophrictus guangxiensis* venom that inhibits the Kv2.1 channel in pancreatic β-cells in the nanomolar range (Herrington et al. 2006). It was hypothesised that GxTx-1E interacts with the voltage sensors (VS) of Kv2.1 (Milescu et al. 2009, Lee et al. 2010). Guangxitoxin (GxTx-1E) was obtained from Alomone Labs.

Example 30: Demonstration that the Inward Omega Current (Iω) Through the Kv2.1 R-1S/R0S/R2S Triple Mutant is Enhanced GxTx The effects of GxTx on the Kv2.1 R-1S/R0S/R2S omega current (Iω) were studied at a concentration above the IC50 estimated for inhibition of the Iα (ionic potassium outward current through the alpha pore, 100 nM GxTx-1E). FIG. 49 (A) illustrates the inward current-voltage relationships of Iω of Kv2.1 R-1S/R0S/R2S in the absence of (squares) and after 5 minutes application of 100 nM GxTx-1E (circles). Inward currents after 5 ms were normalized to the inward current at −300 mV in the control. Normalized inward current amplitudes at the indicated voltages are given as mean values±S.E. FIG. 49 (B) illustrates typical inward currents during hyperpolarising pulses through R-1S/R0S/R2S in the absence of (left) and in the presence of 100 nM GxTx-1E (right). GxTx-1E enhanced Iω of Kv2.1 R-1S/R0S/R2S. This is the first report of a drug molecule that opens a channel omega pore. These data obtained with Kv2.1 R-1S/R0S/R2S also indicate that GxTx-1E is a gating modulator that interacts with the voltage sensor of the Kv2.1 channel.

Example 31: Demonstration that the Inward Omega Current (Iω) Through the Kv2.1 R-1S/R0S/R2S Triple Mutant is not Blocked by 2-guanidinium-benzimidazole (2GBI), 5-[(cyclopentylcarbonyl)amino]-2-(dimethylamino)-N-[(1R)-1-phenylethyl]-benzamide (B1), or 3-methoxy-β-methyl-N-[2-(4-thiazolyl)-1H-benzimidazol-6-yl]-benzenepropanamide (RY785)

Effects on Iω on the Kv2.1 R-1 S/R0S/R2S omega current (Iω) were studied at a concentration above the IC50 estimated for inhibition of the Iα (ionic potassium outward current through the alpha pore, 10 mM 2 GBI, 10 .mu.M B1 and 10 .mu.M R785; the chemical structures of B1 and R785 are described in Herrington et al. (2011) Mol. Pharm. 80:959). FIG. 50, FIG. 51, and FIG. 52 illustrate, respectively, the inward current-voltage relationships of Iω of Kv2.1 R-1S/R0S/R2S in the absence of (squares) and after 5 minutes application of 10 mM 2 GBI, 10 μM B1, or 10 μM R785 (circles). Inward currents after 5 ms in control and the given compound were normalized to the inward current at −300 mV in the control. Normalized inward current amplitudes at the indicated voltages are given as mean values±S.E.

REFERENCES FOR EXAMPLES 29-31

Herrington J, Zhou Y P, Bugianesi R M, Dulski P M, Feng Y, Warren V A, et al. (2006) Blockers of the delayed-rectifier potassium current in pancreatic beta-cells enhance glucose-dependent insulin secretion. *Diabetes* 55(4):1034-42.
Milescu M, Bosmans F, Lee S, Alabi A A, Kim J I, Swartz K J (2009) Interactions between lipids and voltage sensor paddles detected with tarantula toxins. *Nat Struct Mol Biol* 16(10): 1080-5.
Lee S, Milescu M, Jung H H, Lee J Y, Bae C H, Lee C W, et al. (2010) Solution structure of GxTX-1E, a high-affinity tarantula toxin interacting with voltage sensors in Kv2.1 potassium channels. Biochemistry 49(25): 5134-42.
Herrington J, Solly K, Ratliff K S, Li N, Zhou Y P, Howard A, et al. (2011) Identification of novel and selective Kv2 channel inhibitors. *Mol Pharmacol* 80(6): 959-64.

SEQUENCE LISTING (203 sequences)

SEQ ID NO: 1 - protein, 656 aa, Drosophila melanogaster
MAAVAGLYGLGEDRQHRKKQQQQQQHQKEQLEQKEEQKKIAERKLQLREQQLQRNSLDGYGSLPKLSSQDEEGGAGHGFGGGPQHFEPIPHDHDFCERVVINVSGLRFETQLRTLNQFPDTLLGDPARRLRYFDPLRNEYFFDRSRPSFDAILYYYQSGGRLRRPVNVPLDVFSEEIKFYELGDQAINKFREDEGFIKEEERPLPDNEKQRKVWLLFEYPESSQAARVVAIISVFVILLSIVIFCLETLPEFKHYKVFNTTTNGTKIEEDEVPDITDPFFLIETLCIIWFTFELTVRFLACPNKLNFCRDVMNVIDIIAIIPYFITLATVVAEEEDTLNLPKAPVSPQDKSSNQAMSLAILRVIRLVRVFRIFKLSRHSKGLQILGRTLKASMRELGLLIFFLFIGVVLFSSAVYFAEAGSENSFFKSIPDAFWWAVVTMTTVGYGDMTPVGVWGKIVGSLCAIAGVLTIALPVPVIVSNFNYFYHRETDQEEMQSQNFNHVTSCPYLPGTLGQHMKKSSLSESSSDMMDLDDGVESTPGLTETHPGRSAVAPFLGAQQQQQQQPVASSLSMSIDKQLQHPLQHVTQTQLYQQQQQQQQQQQNGFKQQQQQTQQQLQQQQSHTINASAAAATSGSGSSGLTMRHNNALAVSIETDV

SEQ ID NO: 2 - protein, 2009 aa, Homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 3 - protein, 2005 aa, Homo sapiens
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPDKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 4 - protein, 2000 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVSLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 5 - protein, 1836 aa, Homo sapiens
MARPSLCTLARLGPECLRPFTRESLAAIEQRAVEEEARLQRNKQMEIEEPERKPRSDLEAGKNLPMIYGDPPPEVIGIPLEDLDPYYSNKKTFIVLNKGKAIFRFSATPALYLLSPFSVVRRGAIKVLIHALFSMFIMITILTNCVFMTMSDPPPWSKNVEYTFTGIYTFESLIKILARGFCVDDFTFLRDPWNWLDFSVIMMAYLTEFVDLGNISALRTFRVLRALKTITVIPGLKTIVGALIQSVKKLSDVMILTVFCLSVFALVGLQLFMGNLRQKCVRWPPPFNDTNTTWYSNDTWYGNDTWYGNEMWYGNDSWYANDTWNSHASWATNDTFDWDAYISDEGNFYFLEGSNDALLCGNSSDAGHCPKGYECIKTGRNPNYGYTSYDTFSWAFLALFRLMTQDYWENLFQLTLRAAGKTYMIFFVVIIFLGSFYLINLILAVVAMAYAEQNEATLAEDKEKEEEFQQMLEKFKKHQEELEKAKAAQALEGGEADGDPAHGKDCNGSLDTSQGEKGAPRQSGSGDSGISDAMEELEEAHQKCPPWWYKCAHKVLIWDCCAPWLKFKNIIHLIVMDPFVDLGITICIVLNTLFMAMEHYPMTEHFDNVLTVGNLVFTGIFTAEMVLKLIAMDPYEYFQQGWNIFDSIIVTLSLVELGLANVQGLSVLRSFRLLRVFKLAKSWPTLNMLIKIIGNSVGALGNLTLVLAIIVFIFAVVGMQLFGKSYKECVCKIALDCNLPRWHMHDFFHSFLIVFRILCGEWIETMWDCMEVAGQAMCLTVFLMVMVIGNLVVLNLFLALLLSSFSADSLAASDEDGEMNNLQIAIGRIKLGIGFAKAFLLGLLHGKILSPKDIMLSLGEADGAGEAGEAGETAPEDEKKEPPEEDLKKDNHILNHMGLADGPPSSLELDHLNFINNPYLTIQVPIASEESDLEMPTEEETDTFSEPEDSKKPPQPLYDGNSSVCSTADYKPPEEDPEEQAEENPEGEQPEECFTEACVQRWPCLYVDISQGRGKKWWTLRRACFKIVEHNWFETFIVFMILLSSGALAFEDIYIEQRRVIRTILEYADKVFTYIFIMEMLLKWVAYGFKVYFTNAWCWLDFLIVDVSIISLVANWLGYSELGPIKSLRTLRALRPLRALSRFEGMRVVVNALLGAIPSIMNVLLVCLIFWLIFSIMGVNLFAGKFYYCINTTTSERFDISEVNNKSECESLMHTGQVRWLNVKVNYDNVGLGYLSLLQVATFKGWMDIMYAAVDSREKEEQPQYEVNLYMYLYFVIFIIFGSFFTLNLFIGVIIDNFNQQKKKLGGKDIFMTEEQKKYYNAMKKLGSKKPQKPIPRPQNKIQGMVYDLVTKQAFDITIMILICLNMVTMMVETDDQSQLKVDILYNINMIFIIIFTGECVLKMLALRQYYFTVGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPNLENPGTSVKGDCGNPSIGICFFCSYIIISFLIVVNMYIAIILENFNVATEESSEPLGEDDFEMFYETWEKFDPDATQFIAYSRLSDFVDTLQEPLRIAKPNKIKLITLDLPMVPGDKIHCLDILFALTKEVLGDSGEMDALKQTMEEKFMAANPSKVSYEPITTTLKRKHEEVCAIKIQRAYRRHLLQRSMKQASYMYRHSHDGSGDDAPEKEGLLANTMSKMYGHENGNSSSPSPEEKGEAGDAGPTMGLMPISPSDTAWPPAPPPGQTVRPGVKESLV

SEQ ID NO: 6 - protein, 2016 aa, Homo sapiens [sequence omitted]

SEQ ID NO: 7 - protein, 1980 aa, Homo sapiens
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPDWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVSLVSLIANALGYSELGAIKSLRTLRALRPLRALSRFEGMRVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICKKTTSNKLENGGTHREKKESTPSTASLPSYDSVTKPEKEKQQRAEEGRRERAKRQKEVRESKC

SEQ ID NO: 8 - protein, 1977 aa, Homo sapiens
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVRRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 9 - protein, 1956 aa, Homo sapiens
MEFPIGSLETNNFRRFTPESLVEIEKQIAAKQGTKKAREKHREQKDQEEKPRPQLDLKACNQLPKFYGELPAELIGEPLEDLDPFYSTHRTFMVLNKGRTISRFSATRALWLFSPFNLIRRTAIKVSVHSWFSLFITVTILVNCVCMTRTDLPEKIEYVFTVIYTFEALIKILARGFCLNEFTYLRDPWNWLDFSVITLAYVGTAIDLRGISGLRTFRVLRALKTVSVIPGLKVIVGALIHSVKKLADVTILTIFCLSVFALVGLQLFKGNLKNKCVKNDMAVNETTNYSSHRKPDIYINKRGTSDPLLCGNGSDSGHCPDGYICLKTSDNPDFNYTSFDSFAWAFLSLFRLMTQDSWERLYQQTLRTSGKIYMIFFVLVIFLGSFYLVNLILAVVTMAYEEQNQATTDEIEAKEKKFQEALEMLRKEQEVLAALGIDTTSLHSHNGSPLTSKNASERRHRIKPRVSEGSTEDNKSPRSDPYNQRRMSFLGLASGKRRASHGSVFHFRSPGRDISLPEGVTDDGVFPGDHESHRGSLLLGGGAGQQGPLPRSPLPQPSNPDSRHGEDEHQPPPTSELAPGAVDVSAFDAGQKKTFLSAEYLDEPFRAQRAMSVVSIITSVLEELEESEQKCPPCLTSLSQKYLIWDCCPMWVKLKTILFGLVTDPFAELTITLCIVVNTIFMAMEHHGMSPTFEAMLQIGNIVFTIFFTAEMVFKIIAFDPYYYFQKKWNIFDCIIVTVSLLELGVAKKGSLSVLRSFRLLRVFKLAKSWPTLNTLIKIIGNSVGALGNLTIILAIIVFVFALVGKQLLGENYRNNRKNISAPHEDWPRWHMHDFFHSFLIVFRILCGEWIENMWACMEVGQKSICLILFLTVMVLGNLVVLNLFIALLLNSFSADNLTAPEDDGEVNNLQVALARIQVFGHRTKQALCSFFSRSCPFPQPKAEPELVVKLPLSSSKAENHIAANTARGSSGGLQAPRGPRDEHSDFIANPTVWVSVPIAEGESDLDDLEDDGGEDAQSFQQEVIPKGQQEQLQQVERCGDHLTPRSPGTGTSSEDLAPSLGETWKDESVPQVPAEGVDDTSSSEGSTVDCLDPEEILRKIPELADDLEEPDDCFTEGCIRHCPCCKLDTTKSPWDVGWQVRKTCYRIVEHSWFESFIIFMILLSSGSLAFEDYYLDQKPTVKALLEYTDRVFTFIFVFEMLLKWVAYGFKKYFTNAWCWLDFLIVNISLISLTAKILEYSEVAPIKALRTLRALRPLRALSRFEGMRVVVDALVGAIPSIMNVLLVCLIFWLIFSIMGVNLFAGKFWRCINYTDGEFSLVPLSIVNNKSDCKIQNSTGSFFWVNVKVNFDNVAMGYLALLQVATFKGWMDIMYAAVDSREVNMQPKWEDNVYMYLYFVIFIIFGGFFTLNLFVGVIIDNFNQQKKKLGGQDIFMTEEQKKYYNAMKKLGSKKPQKPIPRPLNKFQGFVFDIVTRQAFDITIMVLICLNMITMMVETDDQSEEKTKILGKINQFFVAVFTGECVMKMFALRQYYFTNGWNVFDFIVVVLSIASLIFSAILKSLQSYFSPTLFRVIRLARIGRILRLIRAAKGIRTLLFALMMSLPALFNIGLLLFLVMFIYSIFGMSSFPHVRWEAGIDDMFNFQTFANSMLCLFQITTSAGWDGLLSPILNTGPPYCDPNLPNSNGTRGDCGSPAVGIIFFTTYIIISFLIMVNMYIAVILENFNVATEESTEPLSEDDFDMFYETWEKFDPEATQFITFSALSDFADTLSGPLRIPKPNRNILIQMDLPLVPGDKIHCLDILFAFTKNVLGESGELDSLKANMEEKFMATNLSKSSYEPIATTLRWKQEDISATVIQKAYRSYVLHRSMALSNTPCVPRAEEEAASLPDEGFVAFTANENCVLPDKSETASATSFPPSYESVTRGLSDRVNMRTSSSIQNEDEATSMELIAPGP

SEQ ID NO: 10 - protein, 1791 aa, Homo sapiens
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKKLVNVIILTFFCLSIFALVGQQLFMGSLNLKCISRDCKNISNPEAYDHCFEKKENSPEFKMCGIWMGNSACSIQYECKHTKINPDYNYTNFDNFGWSFLAMFRLMTQDSWEKLYQQTLRTTGLYSVFFFIVVIFLGSFYLINLTLAVVTMAYEEQNKNVAAEIEAKEKMFQEAQQLLKEEKEALVAMGIDRSSLTSLETSYFTPKKRKLFGNKKRKSFFLRESGKDQPPGSDSDEDCQKKPQLLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGSLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQAYELHQENKKPTSQRVQSVEIDMFSEDEPHLTIQDPRKKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSTMISTLENQEHIPFPPTLFRIVRLARIGRILRLVRAARGIRTLLFALMMSLPSLFNIGLLLFLIMFIYAILGMNWFSKVNPESGIDDIFNFKTFASSMLCLFQISTSAGWDSLLSPMLRSKESCNSSSENCHLPGIATSYFVSYIIISFLIVVNMYIAVILENFNTATEESEDPLGEDDFDIFYEVWEKFDPEATQFIKYSALSDFADALPEPLRVAKPNKYQFLVMDLPMVSEDRLHCMDILFAFTARVLGGSDGLDSMKAMMEEKFMEANPLKKLYEPIVTTTKRKEEERGAAIIQKAFRKYMMKVTKGDQGDQNDLENGPHSPLQTLCNGDLSSFGVAKGKVHCD

SEQ ID NO: 11 - protein, 1873 aa, Homo sapiens
MEPSSPQDEGLRKKQPKKPVPEILPRPPRALFCLTLENPLRKACISIVEWKPFETIILLTIFANCVALAVYLPMPEDDNNSLNLGLEKLEYFFLIVFSIEAAMKIIAYGFLFHQDAYLRSGWNVLDFTIVFLGVFTVILEQVNVIQSHTAPMSSKGAGLDVKALRAFRVLRPLRLVSGVPSLQVVLNSIFKAMLPLFHIALLVLFMVIIYAIIGLELFKGKMHKTCYFIGTDIVATVENEEPSPCARTGSGRRCTINGSECRGGCPGPNHGITHFDNFGFSMLTVYQCITMEGWTDVLYWVNDAIGNEWPWIYFVTLILLGSFFILNLVLGVLSGEFTKEREKAKSRGTFQKLREKQQLDEDLRGYMSWITQGEVMDVEDFREGKLSLDEGGSDTESLYEIAGLNKIIQFIRHWRQWNRIFRWKCHDIVKSKVFYWLVILIVALNTLSIASEHHNQPHWLTRLQDIANRVLLSLFTTEMLMKMYGLGLRQYFMSIFNRFDCFVVCSGILEILLVESGAMTPLGISVLRCIRLLRIFKITKYWTSLSNLVASLLNSIRSIASLLLLLFLFIVIFRLLGMQLFGGRYDFEDTEVRRSNFDNFPQALISVFQVLTGEDWTSMMYNGIMASSGPSYPGMLVCIYFIILFVCGNYILLNVFLAIAVDNLAEAESLTSAQKAKAEEKKRRKMSKGLPDKSEEEKSTMAKKLEQKPKGEGIPTTAKLKIDEFESNVNEVKDPYPSADFPGDDEEDEPEIPLSPRPRPLAELQLKEKAVPIPEASSFFIFSPTNKIRVLCHRIVNATWFTNFILLFILLSSAALAAEDPIRADSMRNQILKHFDIGFTSVFTVEIVLKMTTYGAFLHKGSFCRNYFNMLDLLVVAVSLISMGLESSAISVVKILRVLRVLRPLRAINRAKGLKHVARCMFVAISTIGNIVLVTTLLQFMFACIGVQLFKGKFFRCTDLSKMTEEECRGYYYVYKDGDPMQIELRHREWVHSDFHFDNVLSAMMSLFTVSTFEGWPQLLYKAIDSNAEDVGPIYNNRVEMAIFFIIYIILIAFFMMNIFVGFVIVTFQEQGETEYKNCELDKNQRQCVQYALKARPLRCYIPKNPYQYQVWYIVTSSYFEYLMFALIMLNTICLGMQHYNQSEQMNHISDILNVAFTIIFTLEMILKLMAFKARGYFGNPWNVFDFLIVIGSIIDVILSEIDTFLASSGGLYCLGGGCGNVDPDESARISSAFFRLFRVMRLIKLLSRAEGVRTLLWTFIKSFQALPYVALLIVMLFFIYAVIGMQMFGKIALVDGTQINRNNNFQTFPQAVLLLFRCATGEAWQEILLACSYGKLCDPESDYAPGEEYTCGTNFAYYYFISFYMLCAFLVINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDIVQIQAGLRTIEEEAAPEICRTVSGDLAAEEELERAMVEAAMEEGIFRRTGGLFGQVDNFLERTNSLPPVMANQRPLQFAEIEMEEMESPVFLEDFPQDPRTNPLARANTNNANANVAYANSNHSNSHVFSSVHYEREFPEETETPATRGRALGQPCRSLGPHSKPCVEMLKGLLTQRAMPRGQAPPAPCQCPRVESSMPEDRKSSTPGSLHEETPHSRSTRENTSRCSAPATALLIQKALVRGGLGTLAADANFIMATGQALGDACQMEPEEVEIMATELLKGREAPDGMASSLGCLNLGSSLGSLDQHQGSQETLIPPRL

SEQ ID NO: 12 - protein, 2169 aa, Homo sapiens [sequence omitted]

SEQ ID NO: 13 - protein, 2161 aa, Homo sapiens [sequence omitted]

SEQ ID NO: 14 - protein, 1966 aa, Homo sapiens
MSESEGGKDTTPEPSPANGAGPGPEWGLCPGPPAVEGESSGASGLGTPKRRNQHSKHKTVAVASAQRSPRALFCLTLANPLRRSCISIVEWKPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFACIGVQLFKGKFYTCTDEAKHTPQECKGSFLVYPDGDVSRPLVRERLWVNSDFNFDNVLSAMMALFTVSTFEGWPALLYKAIDAYAEDHGPIYNYRVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSNFAIAYFISFFMLCAFLIINLFVAVIMDNFDYLTRDWSILGPHHLDEFKRIWSEYDPGAKGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 15 - protein, 2266 aa, Homo sapiens
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKVEADEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 16 - protein, 2339 aa, Homo sapiens [sequence omitted]

SEQ ID NO: 17 - protein, 2251 aa, Homo sapiens
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLVVTDPSSMRRSFSTIRDKRSNSSWLEEFSMERSSENTYKSRRRSYHSSLRLSAHRLNSDSGHKSDTHPSGGRERRRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNAWLTESSNSPHPQQRQHASPQRYISEPYLALHEDSHASDCVEEETLTFEAAVATSLGRSNTIGSAPPLRHSWQMPNGHYRRRRRGGPGPGMMCGAVNNLLSDTEEDDKC

SEQ ID NO: 18 - protein, 2377 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 19 - protein, 2353 aa, Homo sapiens
MTEGARAADEVRVPLGAPPPGPAALVGASPESPGAPGREAERGSELGVSPSESPAAERGAELGADEEQRVPYPALAATVFFCLGQTTRPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRMPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVISVWEIVGQADGGLSVLRTFRLLRVLKLVRFLPALRRQLVVLVKTMDNVATFCTLLMLFIFIFSILGMHLFGCKFSLKTDTGDTVPDRKNFDSLLWAIVTVFQILTQEDWNVVLYNGMASTSSWAALYFVALMTFGNYVLFNLLVAILVEGFQAEGDANRSDTDEDKTSVHFEEDFHKLRELQTTELKMCSLAVTPNGHLEGRGSLSPPLIMCTAATPMPTPKSSPFLDAAPSLPDSRRGSSSSGDPPLGDQKPPASLRSSPCAPWGPSGAWSSRRSSWSSLGRAPSLKRRGQCGERESLLSGEGKGSTDDEAEDGRAAPGPRATPLRRAESLDPRPLRPAALPPTKCRDRDGQVVALPSDFFLRIDSHREDAAELDDDSEDSCCLRLHKVLEPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRSTFPSPEAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 20 - protein, 2188 aa, Homo sapiens [sequence omitted]

SEQ ID NO: 21 - protein, 495 aa, Homo sapiens
MTVMSGENVDEASAAPGHPQDGSYPRQADHDDHECCERVVINISGLRFETQLKTLAQFPNTLLGNPKKRMRYFDPLRNEYFFDRNRPSFDAILYYYQSGGRLRRPVNVPLDMFSEEIKFYELGEEAMEKFREDEGFIKEEERPLPEKEYQRQVWLLFEYPESSGPARVIAIVSVMVILISIVIFCLETLPELKDDKDFTGTVHRIDNTTVIYNSNIFTDPFFIVETLCIIWFSFELVVRFFACPSKTDFFKNIMNFIDIVAIIPYFITLGTEIAEQEGNQKGEQATSLAILRVIRLVRVFRIFKLSRHSKGLQILGQTLKASMRELGLLIFFLFIGVILFSSAVYFAEAEEAESHFSSIPDAFWWAVVSMTTVGYGDMYPVTIGGKIVGSLCAIAGVLTIALPVPVIVSNFNYFYHRETEGEEQAQLLHVSSPNLASDSDLSRRSSSTMSKSEYMEIEEDMNNSIAHYRQVNIRTANCTTANQNCVNKSKLLTDV

SEQ ID NO: 22 - protein, 499 aa, Homo sapiens
MTVATGDPADEAAALPGHPQDTYDPEADHECCERVVINISGLRFETQLKTLAQFPETLLGDPKKRMRYFDPLRNEYFFDRNRPSFDAILYYYQSGGRLRRPVNVPLDIFSEEIRFYELGEEAMEMFREDEGYIKEEERPLPENEFQRQVWLLFEYPESSGPARIIAIVSVMVILISIVSFCLETLPIFRDENEDMHGSGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLVRVFRIFKLSRHSKGLQILGQTLKASMRELGLLIFFLFIGVILFSSAVYFAEADERESQFPSIPDAFWWAVVSMTTVGYGDMVPTTIGGKIVGSLCAIAGVLTIALPVPVIVSNFNYFYHRETEGEEQAQYLQVTSCPKIPSSPDLKKSRSASTISKSDYMEIQEGVNNSNEDFREENLKTANCTLANTNYVNITKMLTDV

SEQ ID NO: 23 - protein, 575 aa, Homo sapiens
MDERLSLLRSPPPPSARHRAHPPQRPASSGGAHTLVNHGYAEPAAGRELPPDMTVVPGDHLLEPEVADGGGAPPQGGCGGGGCDRYEPLPPSLPAAGEQDCCGERVVINISGLRFETQLKTLCQFPETLLGDPKRRMRYFDPLRNEYFFDRNRPSFDAILYYYQSGGRIRRPVNVPIDIFSEEIRFYQLGEEAMEKFREDEGFLREEERPLPRRDFQRQVWLLFEYPESSGPARGIAIVSVLVILISIVIFCLETLPEFRDEKDYPASTSQDSFEAAGNSTSGSRAGASSFSDPFFVVETLCIIWFSFELLVRFFACPSKATFSRNIMNLIDIVAIIPYFITLGTELAERQGNGQQAMSLAILRVIRLVRVFRIFKLSRHSKGLQILGQTLKASMRELGLLIFFLFIGVILFSSAVYFAEADDPTSGFSSIPDAFWWAVVTMTTVGYGDMHPVTIGGKIVGSLCAIAGVLTIALPVPVIVSNFNYFYHRETEGEEQSQYMHVGSCQHLSSSAEELRKARSNSTLSKSEYMVIEEGGMNHSAFPQTPFKTGNSTATCTTNNNPNSCVNIKKIFTDV

SEQ ID NO: 24 - protein, 653 aa, Homo sapiens
MEVAMVSAESSGCNSHMPYGYAAQARARERERLAHSRAAAAAAVAAATAAVEGSGGSGGGSHHHHQSRGACTSHDPQSSRGSRRRRRQRSEKKKAHYRQSSFPHCSDLMPSGSEEKILRELSEEEEDEEEEEEEEEEGRFYYSEDDHGDECSYTDLLPQDEGGGGYSSVRYSDCCERVVINVSGLRFETQMKTLAQFPETLLGDPEKRTQYFDPLRNEYFFDRNRPSFDAILYYYQSGGRLKRPVNVPFDIFTEEVKFYQLGEEALLKFREDEGFVREEEDRALPENEFKKQIWLLFEYPESSSPARGIAIVSVLVILISIVIFCLETLPEFRDDRDLVMALSAGGHGGLLNDTSAPHLENSGHTIFNDPFFIVETVCIVWFSFEFVVRCFACPSQALFFKNIMNIIDIVSILPYFITLGTDLAQQQGGGNGQQQQAMSFAILRIIRLVRVFRIFKLSRHSKGLQILGHTLRASMRELGLLIFFLFIGVILFSSAVYFAEADEPTTHFQSIPDAFWWAVVTMTTVGYGDMKPITVGGKIVGSLCAIAGVLTIALPVPVIVSNFNYFYHRETENEEQTQLTQNAVSCPYLPSNLLKKFRSSTSSSLGDKSEYLEMEEGVKESLCAKEEKCQGKGDDSETDKNNCSNAKAVETDV

SEQ ID NO: 25 - protein, 613 aa, Homo sapiens
MEIALVPLENGGAMTVRGGDEARAGCGQATGGELQCPPTAGLSDGPKEPAPKGRGAQRDADSGVRPLPPLPDPGVRPLPPLPEELPRPRRPPPEDEEEEGDPGLGTVEDQALGTASLHHQRVHINISGLRFETQLGTLAQFPNTLLGDPAKRLRYFDPLRNEYFFDRNRPSFDGILYYYQSGGRLRRPVNVSLDVFADEIRFYQLGDEAMERFREDEGFIKEEEKPLPRNEFQRQVWLIFEYPESSGSARAIAIVSVLVILISIITFCLETLPEFRDERELLRHPPAPHQPPAPAPGANGSGVMAPPSGPTVAPLLPRTLADPFFIVETTCVIWFTFELLVRFFACPSKAGFSRNIMNIIDVVAIFPYFITLGTELAEQQPGGGGGGQNGQQAMSLAILRVIRLVRVFRIFKLSRHSKGLQILGKTLQASMRELGLLIFFLFIGVILFSSAVYFAEADNQGTHFSSIPDAFWWAVVTMTTVGYGDMRPITVGGKIVGSLCAIAGVLTIALPVPVIVSNFNYFYHRETDHEEPAVLKEEQGTQSQGPGLDRGVQRKVSGSRGSFCKAGGTLENADSARRGSCPLEKCNVKAKSNVDLRRSLYALCLDTSRETDL

SEQ ID NO: 26 - protein, 529 aa, Homo sapiens
MRSEKSLTLAAPGEVRGPEGEQQDAGDFPEAGGGGGCCSSERLVINISGLRFETQLRTLSLFPDTLLGDPGRRVRFFDPLRNEYFFDRNRPSFDAILYYYQSGGRLRRPVNVPLDIFLEEIRFYQLGDEALAAFREDEGCLPEGGEDEKPLPSQPFQRQVWLLFEYPESSGPARGIAIVSVLVILISIVIFCLETLPQFRVDGRGGNNGGVSRVSPVSRGSQEEEEDEDDSYTFHHGITPGEMGTGGSSSLSTLGGSFFTDPFFLVETLCIVWFTFELLVRFSACPSKPAFFRNIMNIIDLVAIFPYFITLGTELVQQQEQQPASGGGGQNGQQAMSLAILRVIRLVRVFRIFKLSRHSKGLQILGKTLQASMRELGLLIFFLFIGVILFSSAVYFAEADDDDSLFPSIPDAFWWAVVTMTTVGYGDMYPMTVGGKIVGSLCAIAGVLTIALPVPVIVSNFNYFYHRETEQEEQGQYTHVTCGQPAPDLRATDNGLGKPDFPEANRERRPSYLPTPHRAYAEKRMLTEV

SEQ ID NO: 27 - protein, 456 aa, Homo sapiens
MEPRCPPPCGCCERLVLNVAGLRFETRARTLGRFPDTLLGDPARRGRFYDDARREYFFDRHRPSFDAVLYYYQSGGRLRRPAHVPLDVFLEEVAFYGLGAAALARLREDEGCPVPPERPLPRRAFARQLWLLFEFPESSQAARVLAVVSVLVILVSIVVFCLETLPDFRDDRDGTGLAAAAAAGPFPAPLNGSSQMPGNPPRLPFNDPFFVVETLCICWFSFELLVRLLVCPSKAIFFKNVMNLIDFVAILPYFVALGTELARQRGVGQQAMSLAILRVIRLVRVFRIFKLSRHSKGLQILGQTLRASMRELGLLIFFLFIGVVLFSSAVYFAEVDRVDSHFTSIPESFWWAVVTMTTVGYGDMAPVTVGGKIVGSLCAIAGVLTISLPVPVIVSNFSYFYHRETEGEEAGMFSHVDMQPCGPLEGKANGGLVDGEVPELPPPLWAPPGKHLVTEV

SEQ ID NO: 28 - protein, 511 aa, Homo sapiens
MDVCGWKEMEVALVNFDNSDEIQEEPGYATDFDSTSPKGRPGGSSFSNGKILISESTNHETAFSKLPGDYADPPGPEPVVLNEGNQRVIINIAGLRFETQLRTLSQFPETLLGDREKRMQFFDSMRNEYFFDRNRPSFDGILYYYQSGGKIRRPANVPIDIFADEISFYELGSEAMDQFREDEGFIKDPETLLPTNDIHRQFWLLFEYPESSSAARAVAVVSVLVVVISITIFCLETLPEFREDRELKVVRDPNLNMSKTVLSQTMFTDPFFMVESTCIVWFTFELVLRFVVCPSKTDFFRNIMNIIDIISIIPYFATLITELVQETEPSAQQNMSLAILRIIRLVRVFRIFKLSRHSKGLQILGQTLKASMRELGLLIFFLFIGVILFSSAVYFAEVDEPESHFSSIPDGFWWAVVTMTTVGYGDMCPTTPGGKIVGTLCAIAGVLTIALPVPVIVSNFNYFYHRETENEEKQNIPGEIERILNSVGSRMGSTDSLNKTNGGCSTEKSRK

SEQ ID NO: 29 - protein, 858 aa, Homo sapiens [sequence omitted]

SEQ ID NO: 30 - protein, 911 aa, Homo sapiens
MAEKAPPGLNRKTSRSTLSLPPEPVDIIRSKTCSRRVKINVGGLNHEVLWRTLDRLPRTRLGKLRDCNTHESLLEVCDDYNLNENEYFFDRHPGAFTSILNFYRTGKLHMMEEMCALSFGQELDYWGIDEIYLESCCQARYHQKKEQMNEELRREAETMREREGEEFDNTCCPDKRKKLWDLLEKPNSSVAAKILAIVSILFIVLSTIALSLNTLPELQETDEFGQLNDNRQLAHVEAVCIAWFTMEYLLRFLSSPNKWKFFKGPLNVIDLLAILPYYVTIFLTESNKSVLQFQNVRRVVQIFRIMRILRILKLARHSTGLQSLGFTLRRSYNELGLLILFLAMGIMIFSSLVFFAEKDEDATKFTSIPASFWWATITMTTVGYGDIYPKTLLGKIVGGLCCIAGVLVIALPIPIIVNNFSEFYKEQKRQEKAIKRREALERAKRNGSIVSMNLKDAFARSMELIDVAVEKAGESANTKDSADDNHLSPSRWKWARKALSETSSNKSFENKYQEVSQKDSHEQLNNTSSSSPQHLSAQKLEMLYNEITKTQPHSHPNPDCQEKPERPSAYEEEIEMEEVVCPQEQLAVAQTEVIVDMKSTSSIDSFTSCATDFTETERSPLPPPSASHLQMKFPTDLPGTEEHQRARGPPFLTLSREKGPAARDGTLEYAPVDITVNLDASGSQCGLHSPLQSDNATDSPKSSLKGSNPLKSRSLKVNFKENRGSAPQTPPSTARPLPVTTADFSLTTPQHISTILLEETPSQGDRPLLGTEVSAPCQGPSKGLSPRFPKQKLFPFSSRERRSFTEIDTGDDEDFLELPGAREEKQVDSSPNCFADKPSDGRDPLREEGSVGSSSPQDTGHNCRQDIYHAVSEVKKDSSQEGCKMENHLFAPEIHSNPGDTGYCPTRETSM

SEQ ID NO: 31 - protein, 511 aa, Homo sapiens
MGQGDESERIVINVGGTRHQTYRSTLRTLPGTRLAWLAEPDAHSHFDYDPRADEFFFDRHPGVFAHILNYYRTGKLHCPADVCGPLYEEELAFWGIDETDVEPCCWMTYRQHRDAEEALDSFGGAPLDNSADDADADGPGDSGDGEDELEMTKRLALSDSPDGRPGGFWRRWQPRIWALFEDPYSSRYARYVAFASLFFILVSITTFCLETHERFNPIVNKTEIENVRNGTQVRYYREAETEAFLTYIEGVCVVWFTFEFLMRVIFCPNKVEFIKNSLNIIDFVAILPFYLEVGLSGLSSKAAKDVLGFLRVVRFVRILRIFKLTRHFVGLRVLGHTLRASTNEFLLLIIFLALGVLIFATMIYYAERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRAGRKPLRGMSI

SEQ ID NO: 32 - protein, 613 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKDNCKEVVITGYTQAEARSLT

SEQ ID NO: 33 - protein, 757 aa, Homo sapiens
MLSSVCVSSFRGRQGASKQQPAPPPQPPESPPPPPLPPQQQQPAQPGPAASPAGPPAPRGPGDRRAEPCPGLPAAAMGRHGGGGGDSGKIVINVGGVRHETYRSTLRTLPGTRLAGLTEPEAAARFDYDPGADEFFFDRHPGVFAYVLNYYRTGKLHCPADVCGPLFEEELGFWGIDETDVEACCWMTYRQHRDAEEALDSFEAPDPAGAANAANAAGAHDGGLDDEAGAGGGGLDGAGGELKRLCFQDAGGGAGGPPGGAGGAGGTWWRRWQPRVWALFEDPYSSRAARYVAFASLFFILISITTFCLETHEGFIHISNKTVTQASPIPGAPPENITNVEVETEPFLTYVEGVCVVWFTFEFLMRITFCPDKVEFLKSSLNIIDCVAILPFYLEVGLSGLSSKAAKDVLGFLRVVRFVRILRIFKLTRHFVGLRVLGHTLRASTNEFLLLIIFLALGVLIFATMIYYAERIGADPDDILGSNHTYFKNIPIGFWWAVVTMTTLGYGDMYPKTWSGMLVGALCALAGVLTIAMPVPVIVNNFGMYYSLAMAKQKLPKKKNKHIPRPPQPGSPNYCKPDPPPPPPPHPHHGSGGISPPPPITPPSMGVTVAGAYPAGPHTHPGLLRGGAGGLGIMGLPPLPAPGEPCPLAQEEVIEINRADPRPNGDPAAAALAHEDCPAIDQPAMSPEDKSPITPGSRGRYSRDRACFLLTDYAPSPDGSIRKATGAPPLPPQDWRKPGPPSFLPDLNANAAAWISP

SEQ ID NO: 34 - protein, 635 aa, Homo sapiens
MISSVCVSSYRGRKSGNKPPSKTCLKEEMAKGEASEKIIINVGGTRHETYRSTLRTLPGTRLAWLADPDGGGRPETDGGGVGSSGSSGGGGCEFFFDRHPGVFAYVLNYYRTGKLHCPADVCGPLFEEELTFWGIDETDVEPCCWMTYRQHRDAEEALDIFESPDGGGSGAGPSDEAGDDERELALQRLGPHEGGAGHGAGSGGCRGWQPRMWALFEDPYSSRAARVVAFASLFFILVSITTFCLETHEAFNIDRNVTEILRVGNITSVHFRREVETEPILTYIEGVCVLWFTLEFLVRIVCCPDTLDFVKNLLNIIDFVAILPFYLEVGLSGLSSKAARDVLGFLRVVRFVRILRIFKLTRHFVGLRVLGHTLRASTNEFLLLIIFLALGVLIFATMIYYAERIGARPSDPRGNDHTDFKNIPIGFWWAVVTMTTLGYGDMYPKTWSGMLVGALCALAGVLTIAMPVPVIVNNFGMYYSLAMAKQKLPKKRKKHVPRPAQLESPMYCKSEETSPRDSTCSDTSPPAREEGMIERKRADSKQNGDANAVLSDEEGAGLTQPLASSPTPEERRALRRSTTRDRNKKAAACFLLSTGDYACADGSVRKGTFVLRDLPLQHSPEAACPPTAGTLFLPH

SEQ ID NO: 35 - protein, 647 aa, Homo sapiens
MAAGLATWLPFARAAAVGWLPLAQQPLPPAPGVKASRGDEVLVVNVSGRRFETWKNTLDRYPDTLLGSSEKEFFYDADSGEYFFDRDPDMFRHVLNFYRTGRLHCPRQECIQAFDEELAFYGLVPELVGDCCLEEYRDRKKENAERLAEDEEAEQAGDGPALPAGSSLRQRLWRAFENPHTSTAALVFYYVTGFFIAVSVIANVVETIPCRGSARRSSREQPCGERFPQAFFCMDTACVLIFTGEYLLRLFAAPSRCRFLRSVMSLIDVVAILPYYIGLLVPKNDDVSGAFVTLRVFRVFRIFKFSRHSQGLRILGYTLKSCASELGFLLFSLTMAIIIFATVMFYAEKGTNKTNFTSIPAAFWYTIVTMTTLGYGDMVPSTIAGKIFGSICSLSGVLVIALPVPVIVSNFSRIYHQNQRADKRRAQQKVRLARIRLAKSGTTNAFLQYKQNGGLEDSGSGEEQALCVRNRSAFEQQHHHLLHCLEKTTCHEFTDELTFSEALGAVSPGGRTSRSTSVSSQPVGPGSLLSSCCPRRAKRRAIRLANSTASVSRGSMQELDMLAGLRRSHAPQSRSSLNAKPHDSLDLNCDSRDFVAAIISIPTPPANTPDESQPSSPGGGGRAGSTLRNSSLGTPCLFPETVKISSL

SEQ ID NO: 36 - protein, 630 aa, Homo sapiens
MAAGVAAWLPFARAAAIGWMPVASGPMPAPPRQERKRTQDALIVLNVSGTRFQTWQDTLERYPDTLLGSSERDFFYHPETQQYFFDRDPDIFRHILNFYRTGKLHYPRHECISAYDEELAFFGLIPEIIGDCCYEEYKDRRRENAERLQDDADTDTAGESALPTMTARQRVWRAFENPHTSTMALVFYYVTGFFIAVSVIANVVETVPCGSSPGHIKELPCGERYAVAFFCLDTACVMIFTVEYLLRLAAAPSRYRFVRSVMSIIDVVAILPYYIGLVMTDNEDVSGAFVTLRVFRVFRIFKFSRHSQGLRILGYTLKSCASELGFLLFSLTMAIIIFATVMFYAEKGSSASKFTSIPAAFWYTIVTMTTLGYGDMVPKTIAGKIFGSICSLSGVLVIALPVPVIVSNFSRIYHQNQRADKRRAQKKARLARIRAAKSGSANAYMQSKRNGLLSNQLQSSEDEQAFVSKSGSSFETQHHHLLHCLEKTTNHEFVDEQVFEESCMEVATVNRPSSHSPSLSSQQGVTSTCCSRRHKKTFRIPNANVSGSHQGSIQELSTIQIRCVERTPLSNSRSSLNAKMEECVKLNCEQPYVTTAIISIPTPPVTTPEGDDRPESPEYSGGNIVRVSAL

SEQ ID NO: 37 - protein, 655 aa, Homo sapiens
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYDDELAFYGILPEIIGDCCYEEYKDRKRENAERLMDDNDSENNQESMPSLSFRQTMWRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASELGFLLFSLTMAIIIFATVMFYAEKGSSASKFTSIPASFWYTIVTMTTLGYGDMVPKTIAGKIFGSICSLSGVLVIALPVPVIVSNFSRIYHQNQRADKRRAQKKARLARIRVAKTGSSNAYLHSKRNGLLNEALELTGTPEEEHMGKTTSLIESQHHHLLHCLEKTTGLSYLVDDPLLSVRTSTIKNHEFIDEQMFEQNCMESSMQNYPSTRSPSLSSHPGLTTTCCSRRSKKTTHLPNSNLPATRLRSMQELSTIHIQGSEQPSLTTSRSSLNLKADDGLRPNCKTSQITTAIISIPTPPALTPEGESRPPPASPGPNTNIPSIASNVVKVSAL

SEQ ID NO: 38 - protein, 494 aa, Homo sapiens
MDGSGERSLPEPGSQSSAASDDIEIVVNVGGVRQVLYGDLLSQYPETRLAELINCLAGGYDTIFSLCDDYDPGKREFYFDRDPDAFKCVIEVYYFGEVHMKKGICPICFKNEMDFWKVDLKFLDDCCKSHLSEKREELEEIARRVQLILDDLGVDAAEGRWRRCQKCVWKFLEKPESSCPARVVAVLSFLLILVSSVVMCMGTIPELQVLDAEGNRVEHPTLENVETACIGWFTLEYLLRLFSSPNKLHFALSFMNIVDVLAILPFYVSLTLTHLGARMMELTNVQQAVQALRIMRIARIFKLARHSSGLQTLTYALKRSFKELGLLLMYLAVGIFVFSALGYTMEQSHPETLFKSIPQSFWWAIITMTTVGYGDIYPKTTLGKLNAAISFLCGVIAIALPIHPIINNFVRYYNKQRVLETAAKHELELMELNSSSGGEGKTGGSRSDLDNLPPEPAGKEAPSCSSRLKLSHSDTFIPLLTEEKHHRTRLQSCK

SEQ ID NO: 39 - protein, 513 aa, Homo sapiens
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPGKVFACLSVLFVTVTAVNLSVSTLPSLREEEEQGHCSQMCHNVFIVESVCVGWFSLEFLLRLIQAPSKFAFLRSPLTLIDLVAILPYYITLLVDGAAAGRRKPGAGNSYLDKVGLVLRVLRALRILYVMRLARHSLGLQTLGLTARRCTREFGLLLLFLCVAIALFAPLLYVIENEMADSPEFTSIPACYWWAVITMTTVGYGDMVPRSTPGQVVALSSILSGILLMAFPVTSIFHTFSRSYLELKQEQERVMFRRAQFLIKTKSQLSVSQDSDILFGSASSDTRDNN

SEQ ID NO: 40 - protein, 466 aa, Homo sapiens
MEPWPCSPGGGGGTRARHVIINVGGCRVRLAWAALARCPLARLERLRACRGHDDLLRVCDDYDVSRDEFFFDRSPCAFRAIVALLRAGKLRLLRGPCALAFRDELAYWGIDEARLERCCLRRLRRREEEAAEARAGPTERGAQGSPARALGPRGRLQRGRRRLRDVVDNPHSGLAGKLFACVSVSFVAVTAVGLCLSTMPDIRAEEERGECSPKCRSLFVLETVCVAWFSFEFLLRSLQAESKCAFLRAPLNIIDILALLPFYVSLLLGLAAGPGGTKLLERAGLVLRLLRALRVLYVMRLARHSLGLRSLGLTMRRCAREFGLLLLFLCVAMALFAPLVHLAERELGARRDFSSVPASYWWAVISMTTVGYGDMVPRSLPGQVVALSSILSGILLMAFPVTSIFHTFSRSYSELKEQQQRAASPEPALQEDSTHSATATEDSSQGPDSAGLADDSADALWVRAGR

SEQ ID NO: 41 - protein, 436 aa, Homo sapiens
MTFGRSGAASVVLNVGGARYSLSRELLKDFPLRRVSRLHGCRSERDVLEVCDDYDRERNEYFFDRHSEAFGFILLYVRGHGKLRFAPRMCELSFYNEMIYWGLEGAHLEYCCQRRLDDRMSDTYTFYSADEPGVLGRDEARPGGAEAAPSRRWLERMRRTFEEPTSSLAAQILASVSVVFVIVSMVVLCASTLPDWRNAAADNRSLDDRSRYSAGPGREPSGIIEAICIGWFTAECIVRFIVSKNKCEFVKRPLNIIDLLAITPYYISVLMTVFTGENSQLQRAGVTLRVLRMMRIFWVIKLARHFIGLQTLGLTLKRCYREMVMLLVFICVAMAIFSALSQLLEHGLDLETSNKDFTSIPAACWWVIISMTTVGYGDMYPITVPGRILGGVCVVSGIVLLALPITFIYHSFVQCYHELKFRSARYSRSLSTEFLN

SEQ ID NO: 42 - protein, 519 aa, Homo sapiens
MPMPSRDGGLHPRHHHYGSHSPWSQLLSSPMETPSIKGLYYRRVRKVGALDASPVDLKKEILINVGGRRYLLPWSTLDRFPLSRLSKLRLCRSYEEIVQLCDDYDEDSQEFFFDRSPSAFGVIVSFLAAGKLVLLQEMCALSFQEELAYWGIEEAHLERCCLRKLLRKLEELEELAKLHREDVLRQQRETRRPASHSSRWGLCMNRLREMVENPQSGLPGKVFACLSILFVATTAVSLCVSTMPDLRAEEDQGECSRKCYYIFIVETICVAWFSLEFCLRFVQAQDKCQFFQGPLNIIDILAISPYYVSLAVSEEPPEDGERPSGSSYLEKVGLVLRVLRALRILYVMRLARHSLGLQTLGLTVRRCTREFGLLLLFLAVAITLFSPLVYVAEKESGRVLEFTSIPASYWWAIISMTTVGYGDMVPRSVPGQMVALSSILSGILIMAFPATSIFHTFSHSYLELKKEQEQLQARLRHLQNTGPASECELLDPHVASEHELMNDVNDLILEGPALPIMHM

SEQ ID NO: 43 - protein, 676 aa, Homo sapiens [sequence omitted]

SEQ ID NO: 44 - protein, 872 aa, Homo sapiens [sequence omitted]

SEQ ID NO: 45 - protein, 872 aa, Homo sapiens
MGLKARRAAGAAGGGGDGGGGGGGAANPAGGDAAAAGDEERKVGLAPGDVEQVTLALGAGADKDGTLLLEGGGRDEGQRRTPQGIGLLAKTPLSRPVKRNNAKYRRIQTLIYDALERPRGWALLYHALVFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGSAFTFPSQQSPRNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 46 - protein, 695 aa, Homo sapiens [sequence omitted]

SEQ ID NO: 47 - protein, 932 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSSQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 48 - protein, 500 aa, Homo sapiens
MPSSGRALLDSPLDSGSLTSLDSSVFCSEGEGEPLALGDCFTVNVGGSRFVLSQQALSCFPHTRLGKLAVVVASYRRPGALAAVPSPLELCDDANPVDNEYFFDRSSQAFRYVLHYYRTGRLHVMEQLCALSFLQEIQYWGIDELSIDSCCRDRYFRRKELSETLDFKKDTEDQESQHESEQDFSQGPCPTVRQKLWNILEKPGSSTAARIFGVISIIFVVVSIINMALMSAELSWLDLQLLEILEYVCISWFTGEFVLRFLCVRDRCRFLRKVPNIIDLLAILPFYITLLVESLSGSQTTQELENVGRIVQVLRLLRALRMLKLGRHSTGLRSLGMTITQCYEEVGLLLLFLSVGISIFSTVEYFAEQSIPDTTFTSVPCAWWWATTSMTTVGYGDIRPDTTTGKIVAFMCILSGILVLALPIAIINDRFSACYFTLKLKEAAVRQREALKKLTKNIATDSYISVNLRDVYARSIMEMLRLKGRERASTRSSGGDDFWF

SEQ ID NO: 49 - protein, 545 aa, Homo sapiens
MLKQSERRRSWSYRPWNTTENEGSQHRRSICSLGARSGSQASIHGWTEGNYNYYIEEDEDGEEEDQWKDDLAEEDQQAGEVTTAKPEGPSDPPALLSTLNVNVGGHSYQLDYCELAGFPKTRLGRLATSTSRSRQLSLCDDYEEQTDEYFFDRDPAVFQLVYNFYLSGVLLVLDGLCPRRFLEELGYWGVRLKYTPRCCRICFEERRDELSERLKIQHELRAQAQVEEAEELFRDMRFYGPQRRRLWNLMEKPFSSVAAKAIGVASSTFVLVSVVALALNTVEEMQQHSGQGEGGPDLRPILEHVEMLCMGFFTLEYLLRLASTPDLRRFARSALNLVDLVAILPLYLQLLLECFTGEGHQRGQTVGSVGKVGQVLRVMRLMRIFRILKLARHSTGLRAFGFTLRQCYQQVGCLLLFIAMGIFTFSAAVYSVEHDVPSTNFTTIPHSWWWAAVSISTVGYGDMYPETHLGRFFAFLCIAFGIILNGMPISILYNKFSDYYSKLKAYEYTTIRRERGEVNFMQRARKKIAECLLGSNPQLTPRQEN

SEQ ID NO: 50 - protein, 526 aa, Homo sapiens
MLMLLVRGTHYENLRSKVVLPTPLGGRSTETFVSEFPGPDTGIRWRRSDEALRVNVGGVRRQLSARALARFPGTRLGRLQAAASEEQARRLCDDYDEAAREFYFDRHPGFFLSLLHFYRTGHLHVLDELCVFAFGQEADYWGLGENALAACCRARYLERRLTQPHAWDEDSDTPSSVDPCPDEISDVQRELARYGAARCGRLRRRLWLTMENPGYSLPSKLFSCVSISVVLASIAAMCIHSLPEYQAREAAAAVAAVAAGRSPEGVRDDPVLRRLEYFCIAWFSFEVSSRLLLAPSTRNFFCHPLNLIDIVSVLPFYLTLLAGVALGDQGGKEFGHLGKVVQVFRLMRIFRVLKLARHSTGLRSLGATLKHSYREVGILLLYLAVGVSVFSGVAYTAEKEEDVGFNTIPACWWWGTVSMTTVGYGDVVPVTVAGKLAASGCILGGILVVALPITIIFNKFSHFYRRQKALEAAVRNSNHQEFEDLLSSIDGVSEASLETSRETSQEGQSADLESQAPSEPPHPQMY

SEQ ID NO: 51 - protein, 477 aa, Homo sapiens
MTGQSLWDVSEANVEDGEIRINVGGFKRRLRSHTLLRFPETRLGRLLLCHSREAILELCDDYDDVQREFYFDRNPELFPYVLHFYHTGKLHVMAELCVFSFSQEIEYWGINEFFIDSCCSYSYHGRKVEPEQEKWDEQSDQESTTSSFDEILAFYNDASKFDGQPLGNFRRQLWLALDNPGYSVLSRVFSILSILVVMGSIITMCLNSLPDFQIPDSQGNPGEDPRFEIVEHFGIAWFTFELVARFAVAPDFLKFFKNALNLIDLMSIVPFYITLVVNLVVESTPTLANLGRVAQVLRLMRIFRILKLARHSTGLRSLGATLKYSYKEVGLLLLYLSVGISIFSVVAYTIEKEENEGLATIPACWWWATVSMTTVGYGDVVPGTTAGKLTASACILAGILVVVLPITLIFNKFSHFYRRQKQLESAMRSCDFGDGMKEVPSVNLRDYYAHKVKSLMASLTNMSRSSPSELSLNDSLR

SEQ ID NO: 52 - protein, 477 aa, Homo sapiens
MTRQSLWDLSETDVEDGEIRINVGGFKRRLRSHTLLRFPETRLGRLLLCHSREAILELCDDYDDVQREFYFDRNPELFPYVLHFYHTGKLHVMAELCVFSFSQEIEYWGINEFFIDSCCSYSYHGRKVEPEQEKWDEQSDQESTTSSFDEILAFYNDASKFDGQPLGNFRRQLWLALDNPGYSVLSRVFSVLSILVVLGSIITMCLNSLPDFQIPDSQGNPGEDPRFEIVEHFGIAWFTFELVARFAVAPDFLKFFKNALNLIDLMSIVPFYITLVVNLVVESSPTLANLGRVAQVLRLMRIFRILKLARHSTGLRSLGATLKYSYKEVGLLLLYLSVGISIFSVVAYTIEKEENEGLATIPACWWWATVSMTTVGYGDVVPGTTAGKLTASACILAGILVVVLPITLIFNKFSHFYRRQKQLESAMRSCDFGDGMKEVPSVNLRDYYAHKVKSLMASLTNMSRSSPSELSLDDSLH

SEQ ID NO: 53 - protein, 989 aa, Homo sapiens
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEVSAFMGDPGKIGFADQIPPPLEGRESQGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEVRHELKEDIKALNAKMTNIEKQLSEILRILTSRRSSQSPQELFEISRPQSPESERDIFGAS

SEQ ID NO: 54 - protein, 988 aa, Homo sapiens
MPGGKRGLVAPQNTFLENIVRRSSESSFLLGNAQIVDWPVVYSNDGFCKLSGYHRADVMQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDDEVVAILGKGDVFGDIFWKETTLAHACANVRALTYCDLHIIKREALLKVLDFYTAFANSFSRNLTLTCNLRKRIIFRKISDVKKEEEERLRQKNEVTLSIPVDHPVRKLFQKFKQQKELRNQGSTQGDPERNQLQVESRSLQNGASITGTSVVTVSQITPIQTSLAYVKTSESLKQNNRDAMELKPNGGADQKCLKVNSPIRMKNGNGKGWLRLKNNMGAHEEKKEDWNNVTKAESMGLLSEDPKSSDSENSVTKNPLRKTDSCDSGITKSDLRLDKAGEARSPLEHSPIQADAKHPFYPIPEQALQTTLQEVKHELKEDIQLLSCRMTALEKQVAEILKILSEKSVPQASSPKSQMPLQVPPQIPCQDIFSVSRPESPESDKDEIHF

SEQ ID NO: 55 - protein, 1159 aa, Homo sapiens
MPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 56 - protein, 994 aa, Homo sapiens
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACIWYAIGNVERPYLEHKIGWLDSLGVQLGKRYNGSDPASGPSVQDKYVTALYFTFSSLTSVGFGNVSPNTNSEKVFSICVMLIGSLMYASIFGNVSAIIQRLYSGTARYHTQMLRVKEFIRFHQIPNPLRQRLEEYFQHAWSYTNGIDMNAVLKGFPECLQADICLHLHRALLQHCPAFSGAGKGCLRALAVKFKTTHAPPGDTLVHLGDVLSTLYFISRGSIEILRDDVVVAILGKNDIFGEPVSLHAQPGKSSADVRALTYCDLHKIQRADLLEVLDMYPAFAESFWSKLEVTFNLRDAAGGLHSSPRQAPGSQDHQGFFLSDNQSGSPHELGPQFPSKGYSLLGPGSQNSMGAGPCAPGHPDAAPPLSISDASGLWPELLQEMPPRHSPQSPQEDPDCWPLKLGSRLEQLQAQMNRLESRVSSDLSRILQLLQKPMPQGHASYILEAPASNDLALVPIASETTSPGPRLPQGFLPPAQTPSYGDLDDCSPKHRNSSPRMPHLAVATDKTLAPSSEQEQPEGLWPPLASPLHPLEVQGLICGPCFSSLPEHLGSVPKQLDFQRHGSDPGFAGSWGH

SEQ ID NO: 57 - protein, 1196 aa, Homo sapiens
MPVRRGHVAPQNTFLGTIIRKFEGQNKKFIIANARVQNCAIIYCNDGFCEMTGFSRPDVMQKPCTCDFLHGPETKRHDIAQIAQALLGSEERKVEVTYYHKNGSTFICNTHIIPVKNQEGVAMMFIINFEYVTDNENAATPERVNPILPIKTVNRKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEDNGRNVKGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLLMCIFALIAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVLKGFPECLQADICLHLNQTLLQNCKAFRGASKGCLRALAMKFKTTHAPPGDTLVHCGDVLTALYFLSRGSIEILKDDIVVAILGKNDIFGEMVHLYAKPGKSNADVRALTYCDLHKIQREDLLEVLDMYPEFSDHFLTNLELTFNLRHESAKADLLRSQSMNDSEGDNCKLRRRKLSFESEGEKENSTNDPEDSADTIRHYQSSKRHFEEKKSRSSSFISSIDDEQKPLFSGIVDSSPGIGKASGLDFEETVPTSGRMHIDKRSHSCKDITDMRSWERENAHPQPEDSSPSALQRAAWGISETESDLTYGEVEQRLDLLQEQLNRLESQMTTDIQTILQLLQKQTTVVPPAYSMVTAGSEYQRPIIQLMRTSQPEASIKTDRSFSPSSQCPEFLDLEKSKLKSKESLSSGVHLNTASEDNLTSLLKQDSDLSLELHLRQRKTYVHPIRHPSLPDSSLSTVGIVGLHRHVSDPGLPGK

SEQ ID NO: 58 - protein, 1107 aa, Homo sapiens
MPVMKGLLAPQNTFLDTIATRFDGTHSNFILANAQVAKGFPIVYCSDGFCELAGFARTEVMQKSCSCKFLFGVETNEQLMLQIEKSLEEKTEFKGEIMFYKKNGSPFWCLLDIVPIKNEKGDVVLFLASFKDITDTKVKITPEDKKEDKVKGRSRAGTHFDSARRRSRAVLYHISGHLQRREKNKLKINNNVFVDKPAFPEYKVSDAKKSKFILLHFSTFKAGWDWLILLATFYVAVTVPYNVCFIGNDDLSTTRSTTVSDIAVEILFIIDIILNFRTTYVSKSGQVIFEARSICIHYVTTWFIIDLIAALPFDLLYAFNVTVVSLVHLLKTVRLLRLLRLLQKLDRYSQHSTIVLTLLMSMFALLAHWMACIWYVIGKMEREDNSLLKWEVGWLHELGKRLESPYYGNNTLGGPSIRSAYIAALYFTLSSLTSVGFGNVSANTDAEKIFSICTMLIGALMHALVFGNVTAIIQRMYSRWSLYHTRTKDLKDFIRVHHLPQQLKQRMLEYFQTTWSVNNGIDSNELLKDFPDELRSDITMHLNKEILQLSLFECASRGCLRSLSLHIKTSFCAPGEYLLRQGDALQAIYFVCSGSMEVLKDSMVLAILGKGDLIGANLSIKDQVIKTNADVKALTYCDLQCIILKGLFEVLDLYPEYAHKFVEDIQHDLTYNLREGHESDVISRLSNKSMVSQSEPKGNGNINKRLPSIVEDEEEEEEGEEEEAVSLSPICTRGSSSRNKKVGSNKAYLGLSLKQLASGTVPFHSPIRVSRSNSPKTKQEIDPPNHNKRKEKNLKLQLSTLNNAGPPDLSPRIVDGIEDGNSSEESQTFDFGSERIRSEPRISPPLGDPEIGAAVLFIKAEETKQQINKLNSEVTTLTQEVSQLGKDMRNVIQLLENVLSPQQPSRFCSLHSTSVCPSRESLQTRTSWSAHQPCLHLQTGGAAYTQAQLCSSNITSDIWSVDPSSVGSSPQRTGAHEQNPADSELYHSPSLDYSPSHYQVVQEGHLQFLRCISPHSDSTLTPLQSISATLSSSVCSSSETSLHLVLPSRSEEGSFSQGTVSSFSLENLPGSWNQEGMASASTKPLENLPLEVVTSTAEVKDNKAINV

SEQ ID NO: 59 - protein, 1083 aa, Homo sapiens
MPAMRGLLAPQNTFLDTIATRFDGTHSNFVLGNAQVAGLFPVVYCSDGFCDLTGFSRAEVMQRGCACSFLYGPDTSELVRQQIRKALDEHKEFKAELILYRKSGLPFWCLLDVIPIKNEKGEVALFLVSHKDISETKNRGGPDRWKETGGGRRRYGRARSKGFNANRRRSRAVLYHLSGHLQKQPKGKHKLNKGVFGEKPNLPEYKVAAIRKSPFILLHCGALRATWDGFILLATLYVAVTVPYSVCVSTAREPSAARGPPSVCDLAVEVLFILDIVLNFRTTFVSKSGQVVFAPKSICLHYVTTWFLLDVIAALPFDLLHAFKVNVYFGAHLLKTVRLLRLLRLLPRLDRYSQYSAVVLTLLMAVFALLAHWVACVWFYIGQREIESSESELPEIGWLQELARRLETPYYLVGRRPAGGNSSGQSDNCSSSSEANGTGLELLGGPSLRSAYITSLYFALSSLTSVGFGNVSANTDTEKIFSICTMLIGALMHAVVFGNVTAIIQRMYARRFLYHSRTRDLRDYIRIHRIPKPLKQRMLEYFQATWAVNNGIDTTELLQSLPDELRADIAMHLHKEVLQLPLFEAASRGCLRALSLALRPAFCTPGEYLIHQGDALQALYFVCSGSMEVLKGGTVLAILGKGDLIGCELPRREQVVKANADVKGLTYCVLQCLQLAGLHDSLALYPEFAPRFSRGLRGELSYNLGAGGGSAEVDTSSLSGDNTLMSTLEEKETDGEQGPTVSPAPADEPSSPLLSPGCTSSSSAAKLLSPRRTAPRPRLGGRGRPGRAGALKAEAGPSAPPRALEGLRLPPMPWNVPPDLSPRVVDGIEDGCGSDQPKFSFRVGQSGPECSSSPSPGPESGLLTVPHGPSEARNTDTLDKLRQAVTELSEQVLQMREGLQSLRQAVQLVLAPHREGPCPRASGEGPCPASTSGLLQPLCVDTGASSYCLQPPAGSVLSGTWPHPRPGPPPLMAPWPWGPPASQSSPWPRATAFWTSTSDSEPPASGDLCSEPSTPASPPPSEEGARTGPAEPVSQAEATSTGEPPPGSGGLALPWDPHSLEMVLIGCHGSGTVQWTQEEGTGV

SEQ ID NO: 60 - protein, 1017 aa, Homo sapiens
MPVMKGLLAPQNTFLDTIATRFDGTHSNFLLANAQGTRGFPIVYCSDGFCELTGYGRTEVMQKTCSCRFLYGPETSEPALQRLHKALEGHQEHRAEICFYRKDGSAFWCLLDMMPIKNEMGEVVLFLFSFKDITQSGSPGLGPQGGRGDSNHENSLGRRGATWKFRSARRRSRTVLHRLTGHFGRRGQGGMKANNNVFEPKPSVPEYKVASVGGSRCLLLHYSVSKAIWDGLILLATFYVAVTVPYNVCFSGDDDTPITSRHTLVSDIAVEMLFILDIILNFRTTYVSQSGQVISAPRSIGLHYLATWFFIDLIAALPFDLLYIFNITVTSLVHLLKTVRLLRLLRLLQKLERYSQCSAVVLTLLMSVFALLAHWMACIWYVIGRREMEANDPLLWDIGWLHELGKRLEVPYVNGSVGGPSRRSAYIAALYFTLSSLTSVGFGNVCANTDAEKIFSICTMLIGALMHAVVFGNVTAIIQRMYSRRSLYHSRMKDLKDFIRVHRLPRPLKQRMLEYFQTTWAVNSGIDANELLRDFPDELRADIAMHLNREILQLPLFGAASRGCLRALSLHIKTSFCAPGEYLLRRGDALQAHYYVCSGSLEVLRDNMVLAILGKGDLIGADIPEPGQEPGLGADPNFVLKTSADVKALTYCGLQQLSSRGLAEVLRLYPEYGAAFRAGLPRDLTFNLRQGSDTSGLSRFSRSPRLSQPRSESLGSSSDKTLPSITEAESGAEPGGGPRPRRPLLLPNLSPARPRGSLVSLLGEELPPFSALVSSPSLSPSLSPALAGQGHSASPHGPPRCSAAWKPPQLLIPPLGTFGPPDLSPRIVDGIEDSGSTAEAPSFRFSRRPELPRPRSQAPPTGTRPSPELASEAEEVKEKVCRLNQEISRLNQEVSQLSRELRHIMGLLQARLGPPGHPAGSAWTPDPPCPQLRPPCLSPCASRPPPSLQDTTLAEVHCPASVGTMETGTALLDLRPSILPPYPSEPDPLGPSPVPEASPPTPSLLRHSFQSRSDTFH

SEQ ID NO: 61 - protein, 890 aa, Homo sapiens
MEGGGKPNSSSNSRDDGNSVFPAKASATGAGPAAAEKRLGTPPGGGGAGAKEHGNSVCFKVDGGGGGGGGGGGGEEPAGGFEDAEGPRRQYGFMQRQFTSMLQPGVNKFSLRMFGSQKAVEKEQERVKTAGFWIIHPYSDFRFYWDLIMLIMMVGNLVIIPVGITFFTEQTTTPWIIFNVASDTVFLLDLIMNFRTGTVNEDSSEIILDPKVIKMNYLKSWFVVDFISSIPVDYIFLIVEKGMDSEVYKTARALRIVRFTKILSLLRLLRLSRLIRYIHQWEEIFHMTYDLASAVVRIFNLIGMMLLLCHWDGCLQFLVPLLQDFPPDCWVSLNEMVNDSWGKQYSYALFKAMSHMLCIGYGAQAPVSMSDLWITMLSMIVGATCYAMFVGHATALIQSLDSSRRQYQEKYKQVEQYMSFHKLPADMRQKIHDYYEHRYQGKIFDEENILNELNDPLREEIVNFNCRKLVATMPLFANADPNFVTAMLSKLRFEVFQPGDYIIREGAVGKKMYFIQHGVAGVITKSSKEMKLTDGSYFGEICLLTKGRRTASVRADTYCRLYSLSVDNFNEVLEEYPMMRRAFETVAIDRLDRIGKKNSILLQKFQKDLNTGVFNNQENEILKQIVKHDREMVQAIAPINYPQMTTLNSTSSTTTPTSRMRTQSPPVYTATSLSHSNLHSPSPSTQTPQPSAILSPCSYTTAVCSPPVQSPLAARTFHYASPTASQLSLMQQQPQQQVQQSQPPQTQPQQPSPQPQTPGSSTPKNEVHKSTQALHNTNLTREVRPLSASQPSLPHEVSTLISRPHPTVGESLASIPQPVTAVPGTGLQAGGRSTVPQRVTLFRQMSSGAIPPNRGVPPAPPPPAAALPRESSSVLNTDPDAEKPRFASNL

SEQ ID NO: 62 - protein, 889 aa, Homo sapiens
MDARGGGGRPGESPGATPAPGPPPPPPPAPPQQQPPPPPPPAPPPGPGPAPPQHPPRAEALPPEAADEGGPRGRLRSRDSSCGRPGTPGAASTAKGSPNGECGRGEPQCSPAGPEGPARGPKVSFSCRGAASGPAPGPGPAEEAGSEEAGPAGEPRGSQASFMQRQFGALLQPGVNKFSLRMFGSQKAVEREQERVKSAGAWIIHPYSDFRFYWDFTMLLFMVGNLIIIPVGITFFKDETTAPWIVFNVVSDTFFLMDLVLNFRTGIVIEDNTEIILDPEKIKKKYLRTWFVVDFVSSIPVDYIFLIVEKGIDSEVYKTARALRIVRFTKILSLLRLLRLSRLIRYIHQWEEIFHMTYDLASAVMRICNLISMMLLLCHWDGCLQFLVPMLQDFPRNCWVSINGMVNHSWSELYSFALFKAMSHMLCIGYGRQAPESMTDIWLTMLSMIVGATCYAMFIGHATALIQSLDSSRRQYQEKYKQVEQYMSFHKLPADFRQKIHDYYEHRYQGKMFDEDSILGELNGPLREEIVNFNCRKLVASMPLFANADPNFVTAMLTKLKFEVFQPGDYIIREGTIGKKMYFIQHGVVSVLTKGNKEMKLSDGSYFGEICLLTRGRRTASVRADTYCRLYSLSVDNFNEVLEEYPMMRRAFETVAIDRLDRIGKKNSILLHKVQHDLNSGVFNNQENAIIQEIVKYDREMVQQAELGQRVGLFPPPPPPPQVTSAIATLQQAAAMSFCPQVARPLVGPLALGSPRLVRRPPPGPAPAAASPGPPPPASPPGAPASPRAPRTSPYGGLPAAPLAGPALPARRLSRASRPLSASQPSLPHGAPGPAASTRPASSSTPRLGPTPAARAAAPSPDRRDSASPGAAGGLDPQDSARSRLSSNL

SEQ ID NO: 63 - protein, 774 aa, Homo sapiens
MEAEQRPAAGASEGATPGLEAVPPVAPPPATAASGPIPKSGPEPKRRHLGTLLQPTVNKFSLRVFGSHKAVEIEQERVKSAGAWIIHPYSDFRFYWDLIMLLLMVGNLIVLPVGITFFKEENSPPWIVFNVLSDTFFLLDLVLNFRTGIVVEEGAEILLAPRAIRTRYLRTWFLVDLISSIPVDYIFLVVELEPRLDAEVYKTARALRIVRFTKILSLLRLLRLSRLIRYIHQWEEIFHMTYDLASAVVRIFNLIGMMLLLCHWDGCLQFLVPMLQDFPPDCWVSINHMVNHSWGRQYSHALFKAMSHMLCIGYGQQAPVGMPDVWLTMLSMIVGATCYAMFIGHATALIQSLDSSRRQYQEKYKQVEQYMSFHKLPADTRQRIHEYYEHRYQGKMFDEESILGELSEPLREEIINFTCRGLVAHMPLFAHADPSFVTAVLTKLRFEVFQPGDLVVREGSVGRKMYFIQHGLLSVLARGARDTRLTDGSYFGEICLLTRGRRTASVRADTYCRLYSLSVDHFNAVLEEFPMMRRAFETVAMDRLLRIGKKNSILQRKRSEPSPGSSGGIMEQHLVQHDRDMARGVRGRAPSTGAQLSGKPVLWEPLVHAPLQAAAVTSNVAIALTHQRGPLPLSPDSPATLLARSAWRSAGSPASPLVPVRAGPWASTSRLPAPPARTLHASLSRAGRSQVSLLGPPPGGGGRRLGPRGRPLSASQPSLPQRATGDGSPGRKGSGSERLPPSGLLAKPPRTAQPPRPPVPEPATPRGLQLSANM

SEQ ID NO: 64 - protein, 1203 aa, Homo sapiens
MDKLPPSMRKRLYSLPQQVGAKAWIMDEEEDAEEEGAGGRQDPSRRSIRLRPLPSPSPSAAAGGTESRSSALGAADSEGPARGAGKSSTNGDCRRFRGSLASLGSRGGGSGGTGSGSSHGHLHDSAEERRLIAEGDASPGEDRTPPGLAAEPERPGASAQPAASPPPPQQPPQPASASCEQPSVDTAIKVEGGAAAGDQILPEAEVRLGQAGFMQRQFGAMLQPGVNKFSLRMFGSQKAVEREQERVKSAGFWIIHPYSDFRFYWDLTMLLLMVGNLIIIPVGITFFKDENTTPWIVFNVVSDTFFLIDLVLNFRTGIVVEDNTEIILDPQRIKMKYLKSWFMVDFISSIPVDYIFLIVETRIDSEVYKTARALRIVRFTKILSLLRLLRLSRLIRYIHQWEEIFHMTYDLASAVVRIVNLIGMMLLLCHWDGCLQFLVPMLQDFPDDCWVSINNMVNNSWGKQYSYALFKAMSHMLCIGYGRQAPVGMSDVWLTMLSMIVGATCYAMFIGHATALIQSLDSSRRQYQEKYKQVEQYMSFHKLPPDTRQRIHDYYEHRYQGKMFDEESILGELSEPLREEIINFNCRKLVASMPLFANADPNFVTSMLTKLRFEVFQPGDYIIREGTIGKKMYFIQHGVVSVLTKGNKETKLADGSYFGEICLLTRGRRTASVRADTYCRLYSLSVDNFNEVLEEYPMMRRAFETVALDRLDRIGKKNSILLHKVQHDLNSGVFNYQENEIIQQIVQHDREMAHCAHRVQAAASATPTPTPVIWTPLIQAPLQAAAATTSVAIALTHHPRLPAAIFRPPPGSGLGNLGAGQTPRHLKRLQSLIPSALGSASPASSPSQVDTPSSSSFHIQQLAGFSAPAGLSPLLPSSSSSPPPGACGSPSAPTPSAGVAATTIAGFGHFHKALGGSLSSSDSPLLTPLQPGARSPQAAQPSPAPPGARGGLGLPEHFLPPPPSSRSPSSSPGQLGQPPGELSLGLATGPLSTPETPPRQPEPPSLVAGASGGASPVGFTPRGGLSPPGHSPGPPRTFPSAPPRASGSHGSLLLPPASSPPPPQVPQRRGTPPLTPGRLTQDLKLISASQPALPQDGAQTLRRASPHSSGESMAAFPLFPRAGGGSGGSGSSGGLGPPGRPYGAIPGQHVTLPRKTSSGSLPPPLSLFGARATSSGGPPLTAGPQREPGARPEPVRSKLPSNL

SEQ ID NO: 65 - protein, 780 aa, Homo sapiens
MDQNSVPEKAQNEADTNNADRFFRSHSSPPHHRPGHSRALHHYELHHHGVPHQRGESHHPPEFQDFHDQALSSHVHQSHHHSEARNHGRAHGPTGFGLAPSQGAVPSHRSYGEDYHDELQRDGRRHHDGSQYGGFHQQSDSHYHRGSHHGRPQYLGENLSHYSSGVPHHGEASHHGGSYLPHGPNPYSESFHHSEASHLSGLQHDESQHHQVPHRGWPHHHQVHHHGRSRHHEAHQHGKSPHHGETISPHSSVGSYQRGISDYHSEYHQGDHHPSEYHHGDHPHHTQHHYHQTHRHRDYHQHQDHHGAYHSSYLHGDYVQSTSQLSIPHTSRSLIHDAPGPAASRTGVFPYHVAHPRGSAHSMTRSSSTIRSRVTQMSKKVHTQDISTKHSEDWGKEEGQFQKRKTGRLQRTRKKGHSTNLFQWLWEKLTFLIQGFREMIRNLTQSLAFETFIFFVVCLNTVMLVAQTFAEVEIRGEWYFMALDSIFFCIYVVEALLKIIALGLSYFFDFWNNLDFFIMAMAVLDFLLMQTHSFAIYHQSLFRILKVFKSLRALRAIRVLRRLSFLTSVQEVTGTLGQSLPSIAAILILMFTCLFLFSAVLRALFRKSDPKRFQNIFTTIFTLFTLLTLDDWSLIYMDSRAQGAWYIIPILIIYIIIQYFIFLNLVITVLVDSFQTALFKGLEKAKQERAARIQEKLLEDSLTELRAAEPKEVASEGTMLKRLIEKKFGTMTEKQQELLFHYLQLVASVEQEQQKFRSQAAVIDEIVDTTFEAGEEDFRN

SEQ ID NO: 66 - protein, 528 aa, Homo sapiens
MAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLSLLPEVVVLVGVTGQSVWLQLLRICRVLRSLKLLAQFRQIQIIILVLVRALKSMTFLLMLLLIFFYIFAVTGVYVFSEYTRSPRQDLEYHVFFSDLPNSLVTVFILFTLDHWYALLQDVWKVPEVSRIFSSIYFILWLLLGSIIFRSIIVAMMVTNFQNIRKELNEEMARREVQLKADMFKRQIIQRRKNMSHEALTSSHSKIEDRGASQQRESLDLSEVSEVESNYGATEEDLITSASKTEETLSKKREYQSSSCVSSTSSSYSSSSESRFSESIGRLDWETLVHENLPGLMEMDQDDRVWPRDSLFRYFELLEKLQYNLEERKKLQEFAVQALMNLEDK

SEQ ID NO: 67 - protein, 398 aa, Homo sapiens
MSQHRHQRHSRVISSSPVDTTSVGFCPTFKKFKRNDDECRAFVKRVIMSRFFKIIMISTVTSNAFFMALWTSYDIRYRLFRLLEFSEIFFVSICTSELSMKVYVDPINYWKNGYNLLDVIIIIVMFLPYALRQLMGKQFTYLYIADGMQSLRILKLIGYSQGIRTLITAVGQTVYTVASVLLLLFLLMYIFAILGFCLFGSPDNGDHDNWGNLAAAFFTLFSLATVDGWTDLQKQLDNREFALSRAFTIIFILLASFIFLNMFVGVMIMHTEDSIRKFERELMLEQQEMLMGEKQVILQRQQEEISRLMHIQKNADCTSFSELVENFKKTLSHTDPMVLDDFGTSLPFIDIYFSTLDYQDTTVHKLQELYYEIVHVLSLMLEDLPQEKPQSLEKVDEK

SEQ ID NO: 68 - protein, 472 aa, Homo sapiens
MRDNEKAWWQQWTSHTGLEGWGGTQEDRMGFGGAVAALRGRPSPLQSTIHESYGRPEEQVLINRQEITNKADAWDMQEFITHMYIKQLLRHPAFQLLLALLLVINAITIALRTNSYLDQKHYELFSTIDDIVLTILLCEVLLGWLNGFWIFWKDGWNILNFIIVFILLLRFFINEINIPSINYTLRALRLVHVCMAVEPLARIIRVILQSVPDMANIMVLILFFMLVFSVFGVTLFGAFVPKHFQNIQVALYTLFICITQDGWVDIYSDFQTEKREYAMEIGGAIYFTIFITIGAFIGINLFVIVVTTNLEQMMKAGEQGQQQRITFSETGAEEEEENDQLPLVHCVVARSEKSGLLQEPLAGGPLSNLSENTCDNFCLVLEAIQENLRQYKEIRDELNMIVEEVRAIRFNQEQESEVLNRRSSTSGSLETTSSKDIRQMSQQQDLLSALVSMEKVHDSSSQILLKKHKSSH

SEQ ID NO: 69 - protein, 273 aa, Homo sapiens
MATWDEKAVTRRAKVAPAERMSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIINGIIISVKTRSERQLLRLKQMNVQLAAKIQHLEFSCSEKEQEIERLNKLLRQHGLLGEVN

SEQ ID NO: 70 - protein, 1182 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 71 - protein, 1235 aa, Homo sapiens
MPLPDGARTPGGVCREARGGGYTNRTFEFDDGQCAPRRPCAGDGALLDTAGFKMSDLDSEVLPLPPRYRFRDLLLGDPSFQNDDRVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYDEMNDHQNTLSYVLINPPPDTRLEPSDIVYLIRSDPLAHVASSSQSRKSSCSHKLSSCNPETRDETQL

SEQ ID NO: 72 - protein, 1135 aa, Homo sapiens
MVDLESEVPPLPPRYRFRDLLLGDQGWQNDDRVQVEFYMNENTFKERLKLFFIKNQRSSLRIRLFNFSLKLLSCLLYIIRVLLENPSQGNEWSHIFWVNRSLPLWGLQVSVALISLFETILLGYLSYKGNIWEQILRIPFILEIINAVPFIISIFWPSLRNLFVPVFLNCWLAKHALENMINDLHRAIQRTQSAMFNQVLILISTLLCLIFTCICGIQHLERIGKKLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNPPDMHFLDAICWFPMVYYMVGSIDNLDDLLRCGVTFAANMVVVDKESTMSAEEDYMADAKTIVNVQTLFRLFSSLSIITELTHPANMRFMQFRAKDCYSLALSKLEKKERERGSNLAFMFRLPFAAGRVFSISMLDTLLYQSFVKDYMISITRLLLGLDTTPGSGFLCSMKITADDLWIRTYARLYQKLCSSTGDVPIGIYRTESQKLTTSESQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYDEMNDHQSTLSYILINPSPDTRIELNDVVYLIRPDPLAYLPNSEPSRRNSICNVTGQDSREETQL

SEQ ID NO: 73 - protein, 888 aa, Homo sapiens
MESCYIAQAGLELLGSSSSPTLTSQSAEITEDASNGGVSEQHPWPSGFERELKPETISSPGYHILRATGEENMAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 74 - protein, 141 aa, Homo sapiens
RKLFSSHRFQVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIINGIIISVKTRSERQLLRLKQ

SEQ ID NO: 75 - protein, 141 aa, Gallus gallus
KKLFSSRRFQIVIVFLVIVDALLVLGELLMDLKIIHPDKYHIAPKVFHYLSLSILTIFLVEVGFKIFVYGREFFHHKFEVLDSIVVVVSFILDLVLLFREHEFEAVGLLILLRLWRVARIINGIILSVKTRSEQQVSKLKQ

SEQ ID NO: 76 - protein, 141 aa, Monodelphis sp.
RKLFGSHRFQVIIICLVIMDALLVLAELMLDLKIIQPDKDNYAARVFHYLSIAILTFFMIEVALKLYVFRLEFFYHKFEILDAVIVIISFVLDIVLLFQEHAFEALGLLILLRLWRVARIINGIIISVKTRSERQLSRLKL

SEQ ID NO: 77 - protein, 141 aa, Rattus norvegicus
RKLFSSHRFQVIIICLVVLDALLVLAELLLDLRIIEPDLSKYSTKVFHYLSLAILAFFVLEISLKVFVFRLEFFHHKFEILDAIVVVVSFVLDLILLFKNHHFEALGLLILLRLWRVARIINGIIISVKTRSERQILRLKQ

SEQ ID NO: 78 - protein, 141 aa, Equus caballus
RKLFSCHRFQVIIICLVILDALLVLAELILDLKIIEADKNNYVPRVFHYMSLAILTFFMTEVSLKIFVFRLEFFHHKFEILDAVVVVVSFVLDIVLIFREHEFEALGLLILLRLWRVARIINGIIISVKTRSERQLLRLKQ

SEQ ID NO: 79 - protein, 141 aa, Bos taurus
RKLFSAHRFQVIIICLVVLDALLVLAELVLDLKIIEPDKNNYAPKVFHYMSLAILTFFMMEIFFKIFVFRLEFFHHKFEILDTIVVVISFILDLVLLFREHQFEALGLLILLRLWRVARIINGIIISVKTRSERQLLRLKQ

SEQ ID NO: 80 - protein, 141 aa, Sus scrofa
RKLFSAHRFQVIIICLVILDALLVLAELVLDLKIIQPDKNNYANRVFHYMSVAILTFFMMEIFFKIFVFRFEFFHHKFEILDAIVVVVSFILDVVLLFREHEFEALGLLILLRLWRVARIINGIIISVKTRSERQLLRLKQ

SEQ ID NO: 81 - protein, 141 aa, Macaca mulatta
RKLFSSHRFQVIIICLVVLDTLLVLAELILDLRIIQPDKKNYAAMIFHYMSIAILALFMMEITFKLFVFRLEFFHHKFEILDAVVVVVSFVLDVVLLFQEHEFEALGLLILLRLWRVARIINGIIISVKTRSERQLLRLKQ

SEQ ID NO: 82 - protein, 141 aa, Macaca mulatta; identical to SEQ ID NO: 81

SEQ ID NO: 83 - protein, 132 aa, Macaca mulatta
EVIIICLVVLDTLLVLAELILDLRIIQPDKKNYAAMIFHYMSIAILALFMMEITFKLFVFRLEFFHHKFEILDAVVVVVSFVLDVVLLFQEHEFEALGLLILLRLWRVARIINGIIISVKTRSERQLLRLKQ

SEQ ID NO: 84 - protein, 141 aa, Canis lupus
RKLFSSHRFQVIIICLVILDALLVLAELILDLKIIQGDKNNYATKVFHYSSFAILTLFMMEVFLKLFVFRLEFFHHKFEILDTFVVVVSFILDLVLLFQKHEFEALGLLILLRLWRVARIINGIIISVKTRSERQLLRLKQ

SEQ ID NO: 85 - protein, 141 aa, Canis lupus; identical to SEQ ID NO: 84

SEQ ID NO: 86 - protein, 141 aa, Mus musculus
RKLFSSHRFQVIIICLVVLDALLVLAELLLDLKIIEPDEQDYAVTAFHYMSFAILVFFMLEIFFKIFVFRLEFFHHKFEILDAFVVVVSFVLDLVLLFKSHHFEALGLLILLRLWRVARIINGIIISVKTRSERQILRLKQ

SEQ ID NO: 87 - protein, 141 aa, Xenopus tropicalis
KWLFSSHKFQIVIICLVILDALFVLVEVLLDLELLAEKVDHIIPEIFHYLSISVLSFFILEIAGKLYAFRLEFFHHKFEVFDAAIVVISFIIDIVYISREDIFNAVGLLILLRLWRVARIVNGIIVSVKTQAEDKIHRLKE

SEQ ID NO: 88 - protein, 141 aa, Xenopus laevis
KWLLSSHKFQIVIICLVILDALFVLVEVLLDLELLAEKVDHIIPEIFHYLSISVLTFFILEIAGKLYAFRLEFFHHKFEVFDAAIVVISFIIDIVYISREDIFNAVGLLILLRLWRVARIVNGVIVSVKTRAEEKMHKLKE

SEQ ID NO: 89 - protein, 141 aa, Danio rerio
RKLYSTERFQIVVVCLVVLDAIFVLCELLIDLSIIEADHHRIAPQVFHYLSLALLTFFMVELAGKIFAYRLEFLHHKFEVFDGIVVVVSFILDIIYISKEDAFDAMGLLILLRLWRVARIINGILVSVQNRANHRVEKLKE

SEQ ID NO: 90 - protein, 141 aa, Tetraodon nigroviridis
KQMYCSERFQILVVCLVILDAIFVLVELLLDLSIIKLDHGSVAPEVFHFLSLGLVVFFLLELAGKLFAFRKEFFDHKFEVFDGLVVTVSFVLDVAFIFHEDAFDGIGLLILLRLWRVARIINGILVSVKTREQQKLHKLKE

SEQ ID NO: 91 - protein, 141 aa, Takifugu sp.
KWLYCSDRFQVLVVCLVILDAIFVLVELLLDLSIIKLDHGNVIPEVFHYLSLALVTFFVVELVGKLFAFRKEFFDHKFEVFDGLVVVVSFVLDVAFIFREDAFDGIGLLILLRLWRVARIINGILVSVKTREQQKLHKLKE

SEQ ID NO: 92 - protein, 140 aa, Nematostella vectensis
CEIIHGQKAQYTIIALVIIDCIIVIAELLVDLEILKVHHDNPAPHILHDVSIAILSLFIIELIVKIYAMGMEFFHHKLEVFDGIVVIVSFALDIAFSGGNAAEGASLLIILRLWRVTRIVNGIILSVKMQDEKKIHHLHK

SEQ ID NO: 93 - protein, 143 aa, Ciona intestinalis
RHILHSKPIHVAIIVLVVLDSFLVVGELLIDLKVIIVPHGNPAPEILHGFSLSILSIFMVEIALKIIADHRHFIHHKVEVLDAVVVVISFGVDIALIFVGESEALAAIGLLVILRLWRVFRIINGIIVTVKTKADDRVHEIKK

SEQ ID NO: 94 - protein, 138 aa, Trichoplax adhaerens
RQLIYSHKVHIAIVVLVILDALIVIAELLIDLSVIKVHHTSPLARAFHFTSIAILAIFLVEIVLKLYASDLAFFLHYFEVFDALIVIVSFVLDIAYSNSEALSGVGLLVVLRLWRIARIVNGIISSVKSQANDKIHHL

SEQ ID NO: 95 - protein, 142 aa, Homo sapiens
HYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKN

SEQ ID NO: 96 - protein, 141 aa, Drosophila melanogaster
HWVVNLPYFDFFIMVVISMSSIALAAEDPVRENSRRNKILNYFDYAFTGVFTIEMLLKIVDLGVILHPGSYLREFWNIMDAVVVICAAVSFGFDMSGSSAGQNLSTIKSLRVLRVLRPLKTIKRVPKLKAVFDCVVNSLKN

SEQ ID NO: 97 - protein, 136 aa, Mus musculus
LRLVCNPWFEHISMLVIMLNCVTLGMFRPCEDVECRSERCSILEAFDDFIFAFFAVEMVIKMVALGLFGQKCYLGDTWNRLDFFIVMAGMMEYSLDGHNVSLSAIRTVRVLRPLRAINRVPSMRILVTLLLDTLPM

SEQ ID NO: 98 - protein, 136 aa, Homo sapiens
IKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPM

SEQ ID NO: 99 - protein, 142 aa, Homo sapiens
HRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKP

SEQ ID NO: 100 - protein, 125 aa, Gallus gallus
IKILVHSLFSMLIMCTILTNCVFMTMSNPPDWTKNVEYTFTGIYTFESLIKILARGFCLEDFTFLRDPWNWLDFTVITFAYVTEFVNLGNVSALRTFRVLRALKTISVIPGLKTIVGALIQSVKK

SEQ ID NO: 101 - protein, 125 aa, Rattus norvegicus
IKILVHSLFNVLIMCTILTNCVFMTMSNPPDWTKNVEYTFTGIYTFESLIKILARGFCLEDFTFLRNPWNWLDFTVITFAYVTEFVNLGNVSALRTFRVLRALKTISVIPGLKTIVGALIQSVKK

SEQ ID NO: 102 - protein, 125 aa, Mus musculus
IKILVHSLFSMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKK

SEQ ID NO: 103 - protein, 125 aa, Mus musculus
IKILVHSLFNVLIMCTILTNCVFMTMSNPPDWTKNVEYTFTGIYTFESLIKILARGFCLEDFTFLRDPWNWLDFTVITFAYVTEFVNLGNVSALRTFRVLRALKTISVIPGLKTIVGALIQSVKK

SEQ ID NO: 104 - protein, 127 aa, Rattus norvegicus
IRISVHSVFSMFIICTVIINCMFMANSMERSFDNDIPEYVFIGIYILEAVIKILARGFIVDEFSFLRDPWNWLDFIVIGTAIATCFPGSQVNLSALRTFRVFRALKAISVISGLKVIVGALLRSVKK

SEQ ID NO: 105 - protein, 130 aa, Mus musculus
IRISVHSVFSMFIICTVIINCMFMANNSSVDSRPSSNIPEYVFIGIYVLEAVIKILARGFIVDEFSYLRDPWNWLDFIVIGTAIAPCFLGNKVNNLSTLRTFRVLRALKAISVISGLKVIVGALLRSVKK

SEQ ID NO: 106 - protein, 130 aa, Homo sapiens
IRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKK

SEQ ID NO: 107 - protein, 125 aa, Taeniopygia guttata
IKILVHSLFSMFIMCTILTNCVFMAQSETPSWNKYVEYTFTGIYTFESLIKILARGFCMTEFTFLRDPWNWLDFSVIVMAYITEFVDLGNVSALRTFRVLRALKTISVISGLKTIVGALIQSVKK

SEQ ID NO: 108 - protein, 125 aa, Rattus norvegicus
VKILVHSLFSMLIMCTILTNCVFMAQHDPPPWTKYVEYTFTAIYTFESLVKILARGFCLHAFTFLRDPWNWLDFSVIVMAYTTEFVDLGNVSALRTFRVLRALKTISVISGLKTIVGALIQSVKK

SEQ ID NO: 109 - protein, 125 aa, Rattus norvegicus
IKILVHSLFSMLIMCTILTNCIFMTLSNPPEWTKNVEYTFTGIYTFESLIKILARGFCVGEFTFLRDPWNWLDFVVIVFAYLTEFVNLGNVSALRTFRVLRALKTISVIPGLKTIVGALIQSVKK

SEQ ID NO: 110 - protein, 125 aa, Oryctolagus cuniculus
IKILVHSLFSMLIMCTILTNCIFMTMNNPAEWTKNVEYTFTGIYTFESLVKIFARGFCVGEFTFLRDPWNWLDFIVIVFAYLTEFVNLGNVSALRTFRVLRALKTISVIPGLKTIVGALIQSVKK

SEQ ID NO: 111 - protein, 125 aa, Homo sapiens
IKILVHSLFSMLIMCTILTNCVFMTLSNPPDWTKNVEYTFTGIYTFESLIKILARGFCLEDFTFLRDPWNWLDFSVIVMAYVTEFVSLGNVSALRTFRVLRALKTISVIPGLKTIVGALIQSVKK

SEQ ID NO: 112 - protein, 118 aa, Canis lupus
IKILVHSLFNVLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGA

SEQ ID NO: 113 - protein, 125 aa, Danio rerio
IKILIHSVFSMFIMCTILTNCVFMTFSNPPEWSKQVEYTFTGIYTFESAVKIIARGFCIDGFTFLRDPWNWLDFMVISMAYVTEFVDLGNVSALRTFRVLRALKTISVIPGLKTIVGALIQSVKK

SEQ ID NO: 114 - protein, 125 aa, Mus musculus
IKILIHSVFSMIIMCTILTNCVFMTFSNPPEWSKNVEYTFTGIYTFESLVKIIARGFCIDGFTFLRDPWNWLDFSVIMMAYVTEFVDLGNVSALRTFRVLRALKTISVIPGLKTIVGALIQSVKK

SEQ ID NO: 115 - protein, 122 aa, Canis lupus
IKVSVHSWFSLFITVTILVNCVGMTQTELPDRIEYVFTVIYTFEALIKILARGFCLNEFAYLRDPWDWLDFSVITLAYIGEATALRGISGLRTFRVLRALKTVSVIPGLKVIVGALIHSVRK

SEQ ID NO: 116 - protein, 125 aa, Homo sapiens
IKVLVHPFFQLFILISVLIDCVFMSLTNLPKWRPVLENTLLGIYTFEILVKLFARGVWAGSFSFLGDPWNWLDFSVTVFEVIIRYSPLDFIPTLQTARTLRILKIIPLNQGLKSLVGVLIHCLKQ

SEQ ID NO: 117 - protein, 149 aa, Oryctolagus cuniculus
ISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMV

SEQ ID NO: 118 - protein, 150 aa, Mus musculus
ISIVEWKPFETIILLTIFANCVALAVYLPMPEDDNNTLNLGLEKLEYFFLIVFSIEAAMKIIAYGFLFHQDAYLRSGWNVLDFIIVFLGVFTVILEQVNIIQTNTAPMSSKGAGLDVKALRAFRVLRPLRLVSGVPSLQVVLNSIFKAML

SEQ ID NO: 119 - protein, 150 aa, Mus musculus
ISIVEWKPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVVNSIMKALV

SEQ ID NO: 120 - protein, 150 aa, Gallus gallus
ISLVEWKPFDIFILLSIFANCVALAVYIPFPEDDSNSTNHNLEKVEYAFLIIFTVETFLKIIAYGLLLHPNAYVRNGWNLLDFVIVVVGLFSVILEQLTKETEGGSHSGGKPGGFDVKALRAFRVLRPLRLVSGVPSLQVVLNSIIKAMV

SEQ ID NO: 121 - protein, 150 aa, Homo sapiens
ISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVP

SEQ ID NO: 122 - protein, 138 aa, Drosophila melanogaster
IRIVEWKPFEFLILLTIFANCIALAVYTPYPGSDSNVTNQTLEKVEYVFLVIFTAECVMKILAYGFVLHNGAYLRNGWNLLDFTIVVIGAISTALSQLMKDAFDVKALRAFRVLRPLRLVSGVPSLQVVLNSILKAMV

SEQ ID NO: 123 - protein, 134 aa, Homo sapiens
KKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIP

SEQ ID NO: 124 - protein, 133 aa, Homo sapiens
KRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMV

SEQ ID NO: 125 - protein, 128 aa, Rattus norvegicus
YQIVKHSWFESFIIFVILLSSGALIFEDVNLPSRPQVEKLLRCTDNIFTFIFLLEMILKWVAFGFRRYFTSAWCWLDFLIVVVSVLSLMNLPSLKSFRTLRALRPLRALSQFEGMKVVVYALISAIPA

SEQ ID NO: 126 - protein, 128 aa, Mus musculus
YQIVKHSWFESFIIFVILLSSGALIFEDVNLPSRPQVEKLLKCTDNIFTFIFLLEMILKWVAFGFRKYFTSAWCWLDFLIVVVSGLSLTNLPNLKSFRNLRALRPLRALSQFEGMKVVVNALMSAIPA

SEQ ID NO: 127 - protein, 135 aa, Rattus norvegicus
YRIVEHSWFESFIVLMILLSSGALAFEDIYIEKKKTIKIILEYADKIFTYIFILEMLLKWVAYGYKTYFTNAWCWLDFLIVDVSLVTLVANTLGYSDLGPIKSLRTLRALRPLRALSRFEGMRVVVNALIGAIPS

SEQ ID NO: 128 - protein, 135 aa, Oryctolagus cuniculus; identical to SEQ ID NO: 127

SEQ ID NO: 129 - protein, 135 aa, Mus musculus; identical to SEQ ID NO: 127

SEQ ID NO: 130 - protein, 162 aa, Mus musculus
TWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEVSAFMGDPGKIGFADQIPPPLEGRESQGISSLFSSLKVVRLLRLGRVARKLDHYIEYGAAVLV

SEQ ID NO: 131 - protein, 140 aa, Mus musculus
GWDWLILLATFYVAVTVPYNVCFIGNEDLSTTRSTTVSDIAVEILFIIDIILNFRTTYVSKSGQVIFEARSICIHYVTTWFIIDLIAALPFDLLYAFNVTVVSLVHLLKTVRLLRLLRLLQKLDRYSQHSTIVLTLLMSM

SEQ ID NO: 132 - protein, 136 aa, Homo sapiens
TWDGFILLATLYVAVTVPYSVCVSTAREPSAARGPPSVCDLAVEVLFILDIVLNFRTTFVSKSGQVVFAPKSICLHYVTTWFLLDVIAALPFDLLHAFKVNVYFGAHLLKTVRLLRLLRLLPRLDRYSQYSAVVLT

SEQ ID NO: 133 - protein, 138 aa, Homo sapiens
HHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQ

SEQ ID NO: 134 - protein, 135 aa, Mus musculus
FDLVTSQVFDVIILGLIVTNMIIMMAESEGQPNEVKKIFDILNIVFVVIFTVECLIKVFALRQHYFTNGWNLFDCVVVVLSIISTLVSGLENSNVFPPTLFRIVRLARIGRILRLVRAARGIRTLLFALMMSLPS

SEQ ID NO: 135 - protein, 135 aa, Rattus norvegicus
FDLVTNQAFDITIMVLICLNMVTMMVEKEGQTEYMDYVLHWINMVFIILFTGECVLKLISLRHYYFTVGWNIFDFVVVILSIVGMFLAEMIEKYFVSPTLFRVIRLARIGRILRLIKGAKGIRTLLFALMMSLPA

SEQ ID NO: 136 - protein, 136 aa, Rattus norvegicus
FDLVTSQVFDVIILGLIVLNMIIMMAESADQPKDVKKTFDILNIAFVVIFTIECLIKVFALRQHYFTNGWNLFDCVVVVLSIISTLVSRLEDSDISFPPTLFRVVRLARIGRILRLVRAARGIRTLLFALMMSLPS

SEQ ID NO: 137 - protein, 128 aa, Homo sapiens
RKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDN

SEQ ID NO: 138 - protein, 135 aa, Homo sapiens
WHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKA

SEQ ID NO: 139 - protein, 128 aa, Drosophila melanogaster
WRIVVSTPFEYFIMMLIVFNTLLLMMKYHNQGDMYEKSLKYINMGFTGMFSVETVLKIIGFGVKNFFKDPWNIFDLITVLGSIVDALWMEFGHDDSNSINVGFLRLFRAARLIKLLRQGYTIRILLWT

SEQ ID NO: 140 - protein, 164 aa, Homo sapiens
WNLMEKPFSSVAAKAIGVASSTFVLVSVVALALNTVEEMQQHSGQGEGGPDLRPILEHVEMLCMGFFTLEYLLRLASTPDLRRFARSALNLVDLVAILPLYLQLLLECFTGEGHQRGQTVGSVGKVGQVLRVMRLMRIFRILKLARHSTGLRAFGFTLRQCYQQ

SEQ ID NO: 141 - protein, 155 aa, Homo sapiens
WKFLEKPESSCPARVVAVLSFLLILVSSVVMCMGTIPELQVLDAEGNRVEHPTLENVETACIGWFTLEYLLRLFSSPNKLHFALSFMNIVDVLAILPFYVSLTLTHLGARMMELTNVQQAVQALRIMRIARIFKLARHSSGLQTLTYALKRSFKE

SEQ ID NO: 142 - protein, 155 aa, Homo sapiens
WDLLEKPNSSVAAKILAIISIMFIVLSTIALSLNTLPELQSLDEFGQSTDNPQLAHVEAVCIAWFTMEYLLRFLSSPKKWKFFKGPLNAIDLLAILPYYVTIFLTESNKSVLQFQNVRRVVQIFRIMRILRILKLARHSTGLQSLGFTLRRSYNE

SEQ ID NO: 143 - protein, 155 aa, Canis lupus
RDLLEKPNSSVAAKILAIVSNLFIVLSTIALSLNTLPELQEMDEFGQPNDNPQLAHVEAVCNAWFTMEYLLRFLSSPNKWKFFKGPLNVIDLLAILPYYVTIFLTESNKSVLQFQNVRRVVQIFRIMRILRILKLARHSTGLQSLGFTLRRSYNE

SEQ ID NO: 144 - protein, 155 aa, Drosophila melanogaster
WELLEKPNTSFAARVIAVISILFIVLSTIALTLNTLPQLQHIDNGTPQDNPQLAMVEAVCITWFTLEYILRFSASPDKWKFFKGGLNIIDLLAILPYFVSLFLLETNKNATDQFQDVRRVVQVFRIMRILRVLKLARHSTGLQSLGFTLRNSYKE

SEQ ID NO: 145 - protein, 149 aa, Pongo abelii
WNILEKPGSSTAARIFGVISIIFVVVSIINMALMSAELSWLDLQLLEILEYVCISWFTGEFVLRFLCVRDRCRFLRKVPNIIDLLAILPFYITLLVESLSGSQTTQELENVGRIVQVLRLLRALRMLKLGRHSTGLRSLGMTITQCYEE

SEQ ID NO: 146 - protein, 152 aa, Homo sapiens
WIRMENPAYCLSAKLIAISSLSVVLASIVAMCVHSMSEFQNEDGEVDDPVLEGVEIACIAWFTGELAVRLAAAPCQKKFWKNPLNIIDFVSIIPFYATLAVDTKEEESEDIENMGKVVQILRLMRIFRILKLARHSVGLRSLGATLRHSYHE

SEQ ID NO: 147 - protein, 172 aa, Saimiri boliviensis
WLTMENPGYSLPSKLFSCVSISVVLASIAAMCIHSLPEYQAREAAAAVAAVAAGRSAEGVRDDPVLRRLEYFCIAWFSFEVSSRLLLAPSTRNFFCHPLNLIDIVSVLPFYLTLLAGAALGDQGGTGGKEFGHLGKVVQVFRLMRIFRVLKLARHSTGLRSLGATLKHSYRE

SEQ ID NO: 148 - protein, 166 aa, Gallus gallus
RDMVENPHSGIPGKIFACISISFVAITAVSLCISTMPDVREEEDRGECSQKCYDIFVLETVCVAWFSFEFLLRSIQAENKCAFLKTPLNIIDILAILPFYISLIVDMASTKNSSKPGGGAGNKYLERVGLVLRFLRALRILYVMRLARHSLGLQTLGLTVRRCTRE

SEQ ID NO: 149 - protein, 163 aa, Homo sapiens
REMVENPQSGLPGKVFACLSILFVATTAVSLCVSTMPDLRAEEDQGECSRKCYYIFIVETICVAWFSLEFCLRFVQAQDKCQFFQGPLNIIDILAISPYYVSLAVSEEPPEDGERPSGSSYLEKVGLVLRVLRALRILYVMRLARHSLGLQTLGLTVRRCTRE

SEQ ID NO: 150 - protein, 171 aa, Rattus norvegicus
WALFEDPYSSRAARYVAFASLFFILISITTFCLETHEGFIHISNKTVTQASPIPGAPPENITNVEVETEPFLTYVEGVCVVWFTFEFLMRVTFCPDKVEFLKSSLNIIDCVAILPFYLEVGLSGLSSKAAKDVLGFLRVVRFVRILRIFKLTRHFVGLRVLGHTLRASTNE

SEQ ID NO: 151 - protein, 166 aa, Homo sapiens
WALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNE

SEQ ID NO: 152 - protein, 168 aa, Drosophila melanogaster
WSLFDEPYSSNAAKTIGVVSVFFICISILSFCLKTHPDMRVPIVRNITVKTANGSNGWFLDKTQTNAHIAFFYIECVCNAWFTFEILVRFISSPNKWEFIKSSVNIIDYIATLSFYIDLVLQRFASHLENADILEFFSIIRIMRLFKLTRHSSGLKILIQTFRASAKE

SEQ ID NO: 153 - protein, 172 aa, Homo sapiens
WLLFEYPESSGPARVIAIVSVMVILISIVIFCLETLPELKDDKDFTGTVHRIDNTTVIYNSNIFTDPFFIVETLCIIWFSFELVVRFFACPSKTDFFKNIMNFIDIVAIIPYFITLGTEIAEQEGNQKGEQATSLAILRVIRLVRVFRIFKLSRHSKGLQILGQTLKASMRE

SEQ ID NO: 154 - protein, 216 aa, Rattus norvegicus
WLLFEYPESSGPARGIAIVSVLVILISIVIFCLETLPQFRADGRGGSNEGSGTRMSPASRGSHEEEDEDEDSYAFPGSIPSGGLGTGGTSSFSTLGGSFFTDPFFLVETLCIVWFTFELLVRFSACPSKAAFFRNIMNIIDLVAIFPYFITLGTELVQRHEQQPVSGGSGQNRQQAMSLAILRVIRLVRVFRIFKLSRHSKGLQILGKTLQASMRE

SEQ ID NO: 155 - protein, 197 aa, Homo sapiens
WLIFEYPESSGSARAIAIVSVLVILISIITFCLETLPEFRDERELLRHPPAPHQPPAPAPGANGSGVMAPPSGPTVAPLLPRTLADPFFIVETTCVIWFTFELLVRFFACPSKAGFSRNIMNIIDVVAIFPYFITLGTELAEQQPGGGGGGQNGQQAMSLAILRVIRLVRVFRIFKLSRHSKGLQILGKTLQASMRE

SEQ ID NO: 156 - protein, 177 aa, Rattus norvegicus
WLLFEYPESSGPARGIAIVSVLVILISIVIFCLETLPEFRDEKDYPASPSQDVFEAANNSTSGASSGASSFSDPFFVVETLCIIWFSFELLVRFFACPSKATFSRNIMNLIDIVAIIPYFITLGTELAERQGNGQQAMSLAILRVIRLVRVFRIFKLSRHSKGLQILGQTLKASMRE

SEQ ID NO: 157 - protein, 175 aa, Canis lupus
WLLFEYPESSGPARGIAIVSVLVILVSIVIFCLETLPEFRDDKDYAAAAQEQPEAARNGTSGPPAAAGFADPFFVVETLCIIWFSFELLVRFFACPSKATFSRNIMNLIDIVAIIPYFITLGTELAERQGNGQQAMSLAILRVIRLVRVFRIFKLSRHSKGLQILGQTLKASMRE

SEQ ID NO: 158 - protein, 184 aa, Bos taurus
WLLFEYPESSSPARGIAIVSVLVILISIVIFCLETLPEFRDDRDLIMALSTGGHGGLLNDTSAPHPENSGHTIFNDPFFIVETVCIVWFSFEFVVRCFACPSQALFFKNIMNIIDIVSILPYFITLGTDLAQQQGGGNGQQQQAMSFAILRIIRLVRVFRIFKLSRHSKGLQILGHTLRASMRE

SEQ ID NO: 159 - protein, 172 aa, Homo sapiens
WLLFEYPESSSAARAVAVVSVLVVVISITIFCLETLPEFREDRELKVVRDPNLNMSKTVLSQTMFTDPFFMVESTCIVWFTFELVLRFVVCPSKTDFFRNIMNIIDIISIIPYFATLITELVQETEPSAQQNMSLAILRIIRLVRVFRIFKLSRHSKGLQILGQTLKASMRE

SEQ ID NO: 160 - protein, 162 aa, Rattus norvegicus
WLLFEYPESSGPARIIAIVSVMVILISIVSFCLETLPIFRDENEDMHGGGVTFHTYSQSTIGYQQSTSFTDPFFIVETLCIIWFSFEFLVRFFACPSKAGFFTNIMNIIDIVAIIPYYVTIFLTESNKSVLQFQNVRRVVQIFRIMRILRIFKLSRHSKGLQ

SEQ ID NO: 161 - protein, 178 aa, Homo sapiens
WLLFEYPESSGPARIIAIVSVMVILISIVSFCLETLPIFRDENEDMHGSGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLVRVFRIFKLSRHSKGLQILGQTLKASMRE

SEQ ID NO: 162 - protein, 178 aa, Rattus norvegicus
WLLFEYPESSGPARIIAIVSVMVILISIVSFCLETLPIFRDENEDMHGGGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLVRVFRIFKLSRHSKGLQILGQTLKASMRE

SEQ ID NO: 163 - protein, 178 aa, Canis lupus; identical to SEQ ID NO: 162

SEQ ID NO: 164 - protein, 182 aa, Drosophila melanogaster
WLLFEYPESSQAARVVAIISVFVILLSIVIFCLETLPEFKHYKVFNTTTNGTKIEEDEVPDITDPFFLIETLCIIWFTFELTVRFLACPNKLNFCRDVMNVIDIIAIIPYFITLATVVAEEEDTLNLPKAPVSPQDKSSNQAMSLAILRVIRLVRVFRIFKLSRHSKGLQILGRTLKASMRE

SEQ ID NO: 165 - protein, 151 aa, Oryctolagus cuniculus
WRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASE

SEQ ID NO: 166 - protein, 133 aa, Homo sapiens
RHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKS

SEQ ID NO: 167 - protein, 132 aa, Drosophila melanogaster
RHTVKTQWFYWFVIVLVFLNTVCVAVEHYGQPSFLTEFLYYAEFIFLGLFMSEMFIKMYALGPRIYFESSFNRFDCVVISGSIFEVIWSEVKGGSFGLSVLRALRLLRIFKVTKYWSSLRNLVISLLNSMRS

SEQ ID NO: 168 - protein, 129 aa, Mus musculus
QTIMTDPFTELAITICIIVNTVFLAMEHHNMDNSLKDILKIGNWVFTGIFIAEMCLKIIALDPYHYFRHGWNIFDSIVALVSLADVLFHKLSKNLSFLASLRVLRVFKLAKSWPTLNTLIKIIGHSVGA

SEQ ID NO: 169 - protein, 130 aa, Rattus norvegicus
RTIMTDPFTELAITICIIINTVFLAVEHHNMDDNLKTILKIGNWVFTGIFIAEMCLKIIALDPYHYFRHGWNVFDSIVALLSLADVLYNTLSDNNRSFLASLRVLRVFKLAKSWPTLNTLIKIIGHSVGA

SEQ ID NO: 170 - protein, 128 aa, Rattus norvegicus
YFIVMDPFVDLAITICIVLNTLFMAMEHHPMTEEFKNVLAVGNLIFTGIFAAEMVLKLIAMDPYEYFQVGWNIFDSLIVTLSLIELFLADVEGLSVLRSFRLLRVFKLAKSWPTLNMLIKIIGNSVGA

SEQ ID NO: 171 - protein, 147 aa, Ornithorhynchus anatinus
WQVFLLSASLNSFLVACVILVVILLTLELLIDIKLLQFSSASQFASVVHWISLIILSVFFTETILRIVVLGIWDYIENKIEVFDGAVIILSLAPMVASTVANGPSSPWDAISLIITLRIWRVKRIIDAYVLPVKVEMEMVIQQYEKA

SEQ ID NO: 172 - protein, 147 aa, Danio rerio
WQVCLLSAGFNCFLVACVILVVLLLTLELLIDTKLLQFNNAFQFACIIHWISLVILSVFFTETVFRIVVLGIWDYIENKVEVFDGAVIVLSLAPMVASTVANGPSSPWDAISLIITLRIWRVKRIIDAYVLQVKVEMELEIQQYEKS

SEQ ID NO: 173 - protein, 147 aa, Monodelphis sp.
WQVFLLSASLNSFLVACVILVVILLTLELLIDIKSLQFSNSSQFAGVSHWISLVILSVFFSETILRIVVLGIWDYIENKIEVFDGAVIILSLAPMVASTIANGPSSPWDAISLTIALRIWRVKRIIDAYVLPVKVELEMVIQQYEKA

SEQ ID NO: 174 - protein, 147 aa, Sus scrofa
WQVFLLSASVNSFLVACVILVVILLTLELLIDIKLLQFSSAFQFAGVIHWISLVILSVFFSETVLRIVVLGIWDYIENKIEVFDGAVIILSLAPMVASTVANGPRSPWDAISLIIMLRIWRVKRVIDAYVLPVKVEMEMVIQQYEKA

SEQ ID NO: 175 - protein, 147 aa, Homo sapiens
WQVFLLSASLNSFLVACVILVVILLTLELLIDIKLLQFSSAFQFAGVIHWISLVILSVFFSETVLRIVVLGIWDYIENKIEVFDGAVIILSLAPMVASTVANGPRSPWDAISLIIMLRIWRVKRVIDAYVLPVKLEMEMVIQQYEKA

SEQ ID NO: 176 - protein, 147 aa, Pan troglodytes; identical to SEQ ID NO: 175

SEQ ID NO: 177 - protein, 147 aa, Equus caballus
WQVFLLSASLNSFLVACVILVVILLTLELLIDIKLLQFSSAFQFAGVIHWISLVILSVFFSETVLRIVVLGIWDYIENKIEVFDGAVIILSLAPMVASTVANGPRSPWDAISLIIMLRIWRVKRVIDAYVLPVKVEMEMVIQQYEKA

SEQ ID NO: 178 - protein, 147 aa, Mus musculus
WQVFLLSASLNSFLVACVILVVILLTLELLIDTKLLQFSNAFQFAGVIHWISLVILSVFFSETVLRIVVLGIWDYIENKIEVFDGAVIILSLAPMVASTVANGPRSPWDAISLIIMFRIWRVKRVIDAYVLPVKLEMEMVTQQYEKA

SEQ ID NO: 179 - protein, 147 aa, Rattus norvegicus
WQVLLLSASLNSFLVACVILVVILLTLELLIDIKLLQFSSAFQFAAVIHWISLVILSVFFSETILRIVVLGIWDYIENKIEVFDGAVIILSLAPMVASTVANGPRSPWDAISLIIMFRIWRVKRVIDAYVLPVKLEMEMVTQQYEKA

SEQ ID NO: 180 - protein, 165 aa, Ciona intestinalis
RKILHSVAFYIYILISTFIVTLLLLAELLIDVGVINIPSSPDTVVLNASALSTLKVQTPAQKTSTILHWISFSFLSLFFIEIMFRLYAWKLNIIRSIVSVFDCSIVTMAIATNLAATLAAGSTSPFDAISLLIILRFIRIHSLIQRCVSDSKQEIREKLTKTECS

SEQ ID NO: 181 - protein, 120 aa, Methanocaldococcus jannaschii
KKIMEVLSLIFTFEIVASFILSTYNPPYQDLLIKLDYISIMFFTFEFIYNFYYVEDKAKFFKDIYNIVDAIVVIAFLLYSLQVFYSKAFLGLRVINLLRILVLLRIIKLRKLEENQALIN

SEQ ID NO: 182 - protein, 139 aa, Ornithorhynchus anatinus
LTTKTEIFGVSLIFVDVALLIVILVTTSKSIRIPFAYRVVSLLIALFFLFDVLLRIFAEGFRNYFSIKLNILDAFIVVGTLMIDIVYIYVNTGGVKQIPRLAILLRPLRIIILIRIFRLAVQKKQLEKVTRRMVSENKR

SEQ ID NO: 183 - protein, 143 aa, Xenopus tropicalis
SPFVMSFGFRVFGVVLIIVDFVLVIVDLSVSTQSSGASTAISSISLSISFFFLIDVLLHIFVEGFRQYFSSKLNIFDAVIVIVTLLVTLVYAFTDFSGASNIPRMVNFLRALRIIILIRILRLASQKRQLEKVTRRLVSENKR

SEQ ID NO: 184 - protein, 143 aa, Gallus gallus
SPFVMSFGFRVFGVVLIIVDIIVVIVDLAISEKKRGIREILEGVSLAIALFFLVDVLMRVFVEGFKNYFRSKLNTLDAVIVVGTLLINMTYSFSDLAATDQMPRMVTLLRVLRIVILIRIFRLASQKKQLEVVTRRMVSENKR

SEQ ID NO: 185 - protein, 143 aa, Danio rerio
TPFVMSFGFRVFGLVLIILDIIMVIVDLSLSEKSRDVGGAPETVSLVISFFFLIDVLLRVYVEGFKVYFSSKLNIVDACIVVITLVVTMIYAFSDFSGASLIPRVVTFLRSLRILILVRIFRLASQKRELEKVTRRMVSENKR

SEQ ID NO: 186 - protein, 143 aa, Xenopus laevis
SPFVMSFGFRVFGVVLIIVDFVLVIVDLSVIDKSREATTAISSISLAISFFFLIDVLLHIFVEGFRQYFSSKLNIFDAAIVIVTLLVTLVYAFTDFSGATNIPRLVNFLRGLRIIILVRILRLASQKRQLEKVTRRLVSENKR

SEQ ID NO: 187 - protein, 143 aa, Rattus norvegicus
HFLVSSVAFRIFGILLIFLDVFLVAIDLHATEKNIYIPLEYRAISLAIALFFLVDVLLRVYVEGRQRYFSDVLNTLDAVVIGVTVLVAVIYTLYDKQFLRNIPRLAVLLRPLRLLILVRILQLAHQKRQLEKLTRQLVSGNKR

SEQ ID NO: 188 - protein, 143 aa, Mus musculus
GILVSSVAFRIFGIFLVILDVFLVVVDLNVSEKKIYIPLDYRSISLAIALFFLVDILLRVSVEGRRRYFSDVLNTLDAVVIGVTVVVAVIYALYDKHFLRDIPRLAVLLRPLRLLILIRILQLAHQKRQLERLTRKLVSGNKR

SEQ ID NO: 189 - protein, 147 aa, Canis lupus
GSSLVSPGHNTNNRIFGILLIFVDLSLIITDLLFTERTMHIPLEYRSISLAIALFFFFDVLLRVYVEGIQRYFSDILNYLDAVIIVVTLLIDIIYMFYDFKFLKTIPRLTILFRPLRLIILIRVFHLAHQKRHLEMLTRRMVSGNKR

SEQ ID NO: 190 - protein, 143 aa, Homo sapiens
HSIVSSFAFGIFGVFLVLLDVTLLLADLIFTDSKLYIPLEYRSISLAIGLFFLMDVLLRVFVEGRQQYFSDLFNILDTAIIVIPLLVDVIYIFFDIKLLRNIPRWTHLVRLLRLIILIRIFHLLHQKRQLEKLMRRLVSENKR

SEQ ID NO: 191 - protein, 143 aa, Homo sapiens
HSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKR

SEQ ID NO: 192 - protein, 141 aa, Ciona intestinalis
RAVIDHLGMRVFGVFLIFLDIILMIIDLSLPGKSESSQSFYDGMALALSCYFMLDLGLRIFAYGPKNFFTNPWEVADGLIIVVTFVVTIFYTVLDEYVQETGADGLGRLVVLARLLRVVRLARIFYSHQQMKASSRRTISQ

SEQ ID NO: 193 - protein, 133 aa, Homo sapiens
GVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIK

SEQ ID NO: 194 - protein, 133 aa, Mus musculus; identical to SEQ ID NO: 193

SEQ ID NO: 195 - protein, 576 aa, Ciona intestinalis
MEGFDGSDFSPPADLVGVDGAVMRNVVDVTINGDVTAPPKAAPRKSESVKKVHWNDVDQGPSEKPETRQEERIDIPEISGLWWGENEHGVDDGRMEIPTTGVGRVQFRVRAVIDHLGMRVFGVFLIFLDIILMIIDLSLPGKSESSQSFYDGMALALSCYFMLDLGLRIFAYGPKNFFTNPWEVADGLIIVVTFVVTIFYTVLDEYVQETGADGLGRLVVLARLLRVVRLARIFYSHQQMKASSRRTISQNKRRYRKDGFDLDLTYVTDHVIAMSFPSSGRQSLFRNPIGEVSRFFKTKHPDKFRIYNLCSERGYDETKFDNHVYRVMIDDHNVPTLVDLLKFIDDAKVWMTSDPDHVIAIHCKGGKGRTGTLVSSWLLEDGKFDTAKEALEYFGSRRTDFEVGDVFQGVETASQIRYVGYFEKIKKNYGGQLPPMKKLKVTGVTITAIQGVGRGNGSDLSMQIVSERQEVLLCKFAEGYNCALQYDATDDCVTCEVKNCPVLAGDIKVRFMSTSKSLPRGYDNCPFYFWFNTSLVEGDHVTLKREEIDNPHKKKTWKIYRDNFTVKLTFSDAEDI

SEQ ID NO: 196 - protein, 511 aa, Danio rerio
MTSVHFNPGLDSKEVNGNSVKEEAEVQIGDGKEETKDPDTMYHQVRKKITPFVMSFGFRVFGLVLIILDIIMVIVDLSLSEKSRDVGGALETVSLVISFFFLIDVLLRVYVEGFKVYFSSKLNIVDACIVVITLVVTMIYAFSDFSGASLIPRVVTFLRSLRILILVRIFRLASQKRELEKVTRRMVSENKRRYQKDGFDLDLTYVTERVIAMSFPSSGKQALYRNPIREVVRFLDTKHMDHYKVFNLCSEKGYDPKFFHYRVERVMIDDHNVPSLDDMLRYTACVRDWMAADSRNVIAIHCKGGKGRTGTMVCTWLIDSDQFESAQESLDYFGERRTDKSMSSKFQGVETPSQSRYVGYYEIMKNQYNRQLPPRKSLKIKSIRIHSIAGVGKGNGSDLKLKIIVKHELVFQCVCAKQHNCTVFPDTGSNAVVISLQDGPIVTGDVKVMFESSAGLPKGYEDCPFYFWFNTSFVENYRLFLSREELDNPHKPKTWDIYKEDFGVTLSFTEP

SEQ ID NO: 197 - protein, 445 aa, Homo sapiens
MNESPQTNEFKGTTEEAPAKESPHTSEFKGAALVSPISKRIFGVFLVLLDVTLLLADLIFTDSKLYIPLEYRSISLAIGLFFLMDVLLRVFVEGWTHLVRLLRLIILIRIFHLLHQKRQLEKLMRRLVSENKRRYTRDGFDLDLTYVTERIIAMSFPSSGRQSFYRNPIEEVVRFLDKKHRNHYRVYNLCSERAYDPKHFHNRVSRIMIDDHNVPTLHEMVVFTKEVNEWMAQDLENIVAIHCKGGKGRTGTMVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSILHDIETDKVLINVYDGPPLYDDVKVQFFSSNLPKYYDNCPFFFWFNTSFIQNNRLCLPRNELDNPHKQKAWKIYPPEFAVEILFGKK

SEQ ID NO: 198 - protein, 522 aa, Homo sapiens [sequence omitted]

SEQ ID NO: 199 - protein, 125 aa, Homo sapiens
IKVLIHALFSMFIMITILTNCVFMTMSDPPPWSKNVEYTFTGIYTFESLIKILARGFCVDDFTFLRDPWNWLDFSVIMMAYLTEFVDLGNISALRTFRVLRALKTITVIPGLKTIVGALIQSVKK

SEQ ID NO: 200 - protein, 8 aa, Artificial Sequence
  Description of Artificial Sequence: Synthetic peptide
  MOD_RES (1)..(1): Thr or Ser
  MOD_RES (2)..(2): Met, Leu or Gln
  MOD_RES (5)..(5): Ile of Val
XXTTXGYG

SEQ ID NO: 201 - protein, 124 aa, Aeropyrum sp.
DVMEHPLVELGVSYAALLSVIVVVVEYTMQLSGEYLVRLYLVDLILVIILWADYAYRAYKSGDPAGYVKKTLYEIPALVPAGLLALIEGHLAGLGLFRLVRLLRFLRILLIISRGSKFLSAIAD

SEQ ID NO: 202 - protein, 46 aa, Homo sapiens
RLSKFEVEDAENVASYDSKIKKIVHSIVSSFAFGLFGVFLVLLDVT

SEQ ID NO: 203 - protein, 144 aa, Drosophila melanogaster
GQHMKKSSLSESSSDMMDLDDGVESTPGLTETHPGRSAVAPFLGAQQQQQQQPVASSLSMSIDKQLQHPLQHVTQTQLYQQQQQQQQQQQNGFKQQQQQTQQQLQQQQSHTINASAAAATSGSGSSGLTMRHNNALAVSIETDV

What is claimed is:

1. A method for identifying a compound which modulates the activity of a voltage-sensitive phosphatase, the method comprising:
   (a) providing a voltage-sensitive phosphatase in a polarized structure that separates a first medium from a second medium, wherein the polarized structure has a voltage difference of about −300 mV to about +300 mV, wherein the voltage-sensitive phosphatase comprises a voltage sensor domain comprising S1 to S4 hydrophobic transmembrane segments and a cytoplasmic phosphatase domain,
   wherein the voltage-sensitive phosphatase exhibits altered voltage sensitivity caused by one or more amino acid mutations in the voltage sensor domain,
   (b) contacting the voltage-sensitive phosphatase with a test compound,
   (c) determining test compound binding to the voltage-sensitive phosphatase, wherein the determining comprises:
      (i) measuring the activity of the voltage-sensitive phosphatase contacted with the test compound,
      (ii) measuring the activity of the voltage-sensitive phosphatase not contacted with the test compound, and
      (iii) comparing the amount of said activity measured in steps (i) and (ii) wherein an increase or decrease in the amount of activity of the voltage-sensitive phosphatase contacted with the test compound compared to the voltage-sensitive phosphatase not contacted with the test compound indicates that the test compound modulates the activity of the voltage-sensitive phosphatase.

2. The method of claim 1, wherein the structure is a lipid bilayer.

3. The method of claim 1, wherein the structure is a liposome membrane.

4. The method of claim 1, wherein the structure comprises a naturally occurring membrane, a synthetic membrane, or any combination thereof.

5. The method of claim 1, wherein the structure is a cellular membrane of a cell.

6. The method of claim 5, wherein the cell is an animal cell, a plant cell, a fungal cell, a yeast cell, a bacterial cell, or an archaebacterial cell.

7. The method of claim 5, wherein the cell is an oocyte, a fibroblast, an epithelial cell, or a myocyte.

8. The method of claim 5, wherein the cell is a cell from a cell line.

9. The method of claim 5, wherein the cellular membrane is in a cell.

10. The method of claim 5, wherein the cellular membrane is in a permeabilized cell.

11. The method of claim 5, wherein the cellular membrane is not in a cell.

12. The method of claim 5, wherein the cellular membrane comprises an extracellular membrane, an intracellular membrane, a vesicular membrane, an organelle membrane, or any combination thereof.

13. The method of claim 1, wherein the contacting of step (b) is performed by adding the compound to either the first medium or the second medium.

14. The method of claim 1, wherein the contacting of step (b) is performed by adding the compound to the first medium and the second medium.

15. The method of claim 1, wherein the one or more of the amino acid mutations are in the S4 hydrophobic transmembrane segment.

16. The method of claim 1, wherein one or more of the amino acid mutations are not in the S4 hydrophobic transmembrane segment.

17. The method of claim 1, wherein at least one of the amino acid mutations is in the S4 hydrophobic transmembrane segment and at least one of the amino acid mutations is not in the S4 hydrophobic transmembrane segment.

18. The method of claim 1, further comprising a step of contacting the voltage sensitive phosphatase with MTSET or MTSES before step (b).

* * * * *